US009815901B2

(12) United States Patent
Brogdon et al.

(10) Patent No.: US 9,815,901 B2
(45) Date of Patent: Nov. 14, 2017

(54) TREATMENT OF CANCER USING A CD123 CHIMERIC ANTIGEN RECEPTOR

(71) Applicants: Jennifer Brogdon, Cambridge, MA (US); Saar Gill, Philadelphia, PA (US); David Glass, Cambridge, MA (US); Saad Kenderian, Philadelphia, PA (US); Andreas Loew, Cambridge, MA (US); Joan Mannick, Cambridge, MA (US); Michael C. Milone, Cherry Hill, NJ (US); Leon Murphy, Cambridge, MA (US); David L. Porter, Springfield, PA (US); Marco Ruella, Philadelphia, PA (US); Yongqiang Wang, Shanghai (CN); Qilong Wu, Shanghai (CN); Jiquan Zhang, Shanghai (CN)

(72) Inventors: Jennifer Brogdon, Cambridge, MA (US); Saar Gill, Philadelphia, PA (US); David Glass, Cambridge, MA (US); Saad Kenderian, Philadelphia, PA (US); Andreas Loew, Cambridge, MA (US); Joan Mannick, Cambridge, MA (US); Michael C. Milone, Cherry Hill, NJ (US); Leon Murphy, Cambridge, MA (US); David L. Porter, Springfield, PA (US); Marco Ruella, Philadelphia, PA (US); Yongqiang Wang, Shanghai (CN); Qilong Wu, Shanghai (CN); Jiquan Zhang, Shanghai (CN)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 0 days.

(21) Appl. No.: 14/830,392

(22) Filed: Aug. 19, 2015

(65) Prior Publication Data
US 2016/0068601 A1    Mar. 10, 2016

(30) Foreign Application Priority Data

Aug. 19, 2014  (WO) ............... PCT/CN2014/084696
Nov. 6, 2014   (WO) ............... PCT/CN2014/090508

(51) Int. Cl.
*C07K 16/28* (2006.01)
*C12N 5/078* (2010.01)
*C12N 5/0783* (2010.01)
*A61K 39/00* (2006.01)
*C07K 16/24* (2006.01)

(52) U.S. Cl.
CPC ...... *C07K 16/2866* (2013.01); *A61K 39/0011* (2013.01); *C07K 16/244* (2013.01); *C12N 5/0636* (2013.01); *A61K 2039/505* (2013.01); *A61K 2039/507* (2013.01); *A61K 2039/5156* (2013.01); *C07K 2317/24* (2013.01); *C07K 2317/622* (2013.01); *C07K 2317/73* (2013.01); *C07K 2317/76* (2013.01); *C07K 2319/03* (2013.01); *C07K 2319/33* (2013.01)

(58) Field of Classification Search
None
See application file for complete search history.

(56) References Cited

U.S. PATENT DOCUMENTS

| 5,359,046 | A  | 10/1994 | Capon et al. |
| 5,541,063 | A  | 7/1996  | Kitamura et al. |
| 5,639,605 | A  | 6/1997  | Kitamura et al. |
| 5,686,281 | A  | 11/1997 | Roberts |
| 5,712,149 | A  | 1/1998  | Roberts |
| 5,874,240 | A  | 2/1999  | Ni et al. |
| 5,906,936 | A  | 5/1999  | Eshhar et al. |
| 6,103,521 | A  | 8/2000  | Capon et al. |
| 6,177,078 | B1 | 1/2001  | Lopez |
| 6,319,494 | B1 | 11/2001 | Capon et al. |
| 6,355,779 | B1 | 3/2002  | Goodwin et al. |
| 6,410,319 | B1 | 6/2002  | Raubitschek et al. |
| 6,569,997 | B1 | 5/2003  | Kwon |
| 7,049,136 | B2 | 5/2006  | Seed et al. |
| 7,052,906 | B1 | 5/2006  | Lawson et al. |
| 7,070,995 | B2 | 7/2006  | Jensen |
| 7,265,209 | B2 | 9/2007  | Jensen |
| 7,319,143 | B2 | 1/2008  | Gross et al. |
| 7,320,787 | B2 | 1/2008  | Seed et al. |
| 7,446,190 | B2 | 11/2008 | Sadelain et al. |

(Continued)

FOREIGN PATENT DOCUMENTS

| CN | 102796198 A | 11/2012 |
| CN | 103492406 A | 1/2014 |

(Continued)

OTHER PUBLICATIONS

Rudikoff et al. (PNAS USA, 1982, 79: 1979-1983).*
Coleman et al. (Research in Immunology, 1994; 145(1): 33-36).*
Abaza et al. (Journal of Protein Chemistry, vol. 11, No. 5, 1992, pp. 433-444.*
Ibragimova and Wade (Biophysical Journal, Oct. 1999, vol. 77, pp. 2191-2198).*
Gussow et al. (1991, Methods in Enzymology 203:99-121).*
Sadelain et al., "Targeting Tumours with Genetically Enhanced T Lymphocytes," Nature Reviews: Cancer 3: 35-45 (2003).

(Continued)

*Primary Examiner* — Peter J Reddig
(74) *Attorney, Agent, or Firm* — Lando & Anastasi, LLP

(57) ABSTRACT

The invention provides compositions and methods for treating diseases associated with expression of CD123. The invention also relates to chimeric antigen receptor (CAR) specific to CD123, vectors encoding the same, and recombinant cells comprising the CD123 CAR. The invention also includes methods of administering a genetically modified cell expressing a CAR that comprises a CD123 binding domain.

40 Claims, 97 Drawing Sheets

(56) References Cited

U.S. PATENT DOCUMENTS

| | | |
|---|---|---|
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,492,119 B2 | 7/2013 | Tawara et al. |
| 8,637,307 B2 | 1/2014 | June et al. |
| 8,722,400 B2 | 5/2014 | Riley et al. |
| 8,852,551 B2 | 10/2014 | Jordan |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 2003/0039611 A1 | 2/2003 | Jordan |
| 2003/0060444 A1 | 3/2003 | Finney et al. |
| 2003/0077249 A1 | 4/2003 | Bebbington et al. |
| 2003/0105000 A1* | 6/2003 | Pero .................. A61K 38/06 514/19.3 |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2009/0252742 A1 | 10/2009 | Bergstein |
| 2009/0257994 A1 | 10/2009 | Jensen |
| 2011/0052554 A1 | 3/2011 | Zakrzewski et al. |
| 2011/0052574 A1 | 3/2011 | Dick et al. |
| 2012/0070448 A1 | 3/2012 | Tawara et al. |
| 2012/0070450 A1 | 3/2012 | Ishikawa et al. |
| 2012/0148552 A1 | 6/2012 | Jensen |
| 2012/0189540 A1 | 7/2012 | Bergstein |
| 2012/0244116 A1 | 9/2012 | Hiwase et al. |
| 2012/0321667 A1 | 12/2012 | Sentman |
| 2012/0328619 A1 | 12/2012 | Fey et al. |
| 2013/0071409 A1 | 3/2013 | Riley et al. |
| 2013/0071414 A1 | 3/2013 | Dotti et al. |
| 2013/0149303 A1 | 6/2013 | Drane et al. |
| 2013/0149337 A1 | 6/2013 | Cooper et al. |
| 2013/0155909 A1 | 6/2013 | Jackson et al. |
| 2013/0230510 A1 | 9/2013 | Dick et al. |
| 2013/0287748 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370045 A1 | 12/2014 | June et al. |
| 2015/0017141 A1 | 1/2015 | June et al. |
| 2015/0119555 A1 | 4/2015 | Jung et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |

FOREIGN PATENT DOCUMENTS

| | | |
|---|---|---|
| EP | 0574512 A1 | 12/1993 |
| EP | 0871495 A1 | 10/1998 |
| EP | 01226244 A2 | 7/2002 |
| WO | 9215322 A1 | 9/1992 |
| WO | 9530014 A1 | 11/1995 |
| WO | 9623814 A1 | 8/1996 |
| WO | 9624671 A1 | 8/1996 |
| WO | 9715669 A1 | 5/1997 |
| WO | 9723613 A2 | 7/1997 |
| WO | 9724373 A1 | 7/1997 |
| WO | 9818809 A1 | 5/1998 |
| WO | 9900494 A2 | 1/1999 |
| WO | 9957268 A1 | 11/1999 |
| WO | 0014257 A1 | 3/2000 |
| WO | 0233101 A1 | 4/2002 |
| WO | 02077029 A2 | 10/2002 |
| WO | 02088334 A1 | 11/2002 |
| WO | 03057171 A2 | 7/2003 |
| WO | 2005019429 A2 | 3/2005 |
| WO | 2005044996 A2 | 5/2005 |
| WO | 2005/118788 A2 | 12/2005 |
| WO | 2006060878 A1 | 6/2006 |
| WO | 2008045437 A2 | 4/2008 |
| WO | 2008127735 A1 | 10/2008 |
| WO | 2010085660 A2 | 7/2010 |
| WO | 2010126066 A1 | 11/2010 |
| WO | 2011059836 A2 | 5/2011 |
| WO | 2011070109 A1 | 6/2011 |
| WO | 2011097477 A1 | 8/2011 |
| WO | 2011156860 A1 | 12/2011 |
| WO | 2012033885 A1 | 3/2012 |
| WO | 2012058460 A2 | 5/2012 |
| WO | 2012079000 A1 | 6/2012 |
| WO | 2012082841 A2 | 6/2012 |
| WO | 2012/099973 A2 | 7/2012 |
| WO | 2012127464 A2 | 9/2012 |
| WO | 2012129514 A1 | 9/2012 |
| WO | 2012135854 A2 | 10/2012 |
| WO | 2012138858 A1 | 10/2012 |
| WO | 2013019615 A2 | 2/2013 |
| WO | 2013033626 A2 | 3/2013 |
| WO | 2013040371 A2 | 3/2013 |
| WO | 2013040557 A2 | 3/2013 |
| WO | 2013059593 A1 | 4/2013 |
| WO | 2013092001 A1 | 6/2013 |
| WO | 2013/126712 A1 | 8/2013 |
| WO | 2013126726 A1 | 8/2013 |
| WO | 2013126729 A1 | 8/2013 |
| WO | 2013126733 A1 | 8/2013 |
| WO | 2013173820 A2 | 11/2013 |
| WO | 2014/011984 A1 | 1/2014 |
| WO | 2014/011987 A1 | 1/2014 |
| WO | 2014/011993 A2 | 1/2014 |
| WO | 2014/012001 A2 | 1/2014 |
| WO | 2014011988 A2 | 1/2014 |
| WO | 2014011996 A1 | 1/2014 |
| WO | 2014031687 A1 | 2/2014 |
| WO | 2014039513 A2 | 3/2014 |
| WO | 2014/055442 A2 | 4/2014 |
| WO | 2014055657 A1 | 4/2014 |
| WO | 2014130635 A1 | 8/2014 |
| WO | 2014/145252 A2 | 9/2014 |
| WO | 2014138805 A1 | 9/2014 |
| WO | 2014138819 A1 | 9/2014 |
| WO | 2014144622 A2 | 9/2014 |
| WO | 2014153270 A1 | 9/2014 |
| WO | 2015044386 A1 | 4/2015 |
| WO | 2015090229 A1 | 6/2015 |
| WO | 2015090230 A1 | 6/2015 |
| WO | 2015112626 A1 | 7/2015 |
| WO | 2015124715 A1 | 8/2015 |

(56) References Cited

FOREIGN PATENT DOCUMENTS

| WO | 2015/142661 A1 | 9/2015 |
|---|---|---|
| WO | 2015142675 A2 | 9/2015 |
| WO | 2015157252 A1 | 10/2015 |
| WO | 2016014501 A1 | 1/2016 |
| WO | 2016014530 A1 | 1/2016 |
| WO | 2016014535 A1 | 1/2016 |
| WO | 2016014553 A1 | 1/2016 |
| WO | 2016014565 A2 | 1/2016 |
| WO | 2016014576 A1 | 1/2016 |
| WO | 2016019300 A1 | 2/2016 |
| WO | 2016025880 A1 | 2/2016 |
| WO | 2016028896 A1 | 2/2016 |
| WO | 2016044605 A1 | 3/2016 |

OTHER PUBLICATIONS

Sato et al, "Expression and factor-dependent modulation of the interleukin-3 receptor subunits on human hematopoietic cells" Blood (1993) vol. 82 No. 3 pp. 752-761.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Testa et al, Elevated expression of IL-3R_ in acute myelogenous leukemia is associated with enhanced blast proliferation, increased cellularity, and poor prognosis Blood (2002) vol. 100 No. 8 pp. 2980-2988.
Tettamanti et al., "Targeting of the acute myeloid leukemia stem cells through immunotherapy: development of novel chimeric receptors specific for the CD123 antigen," OMICS group conference 2nd world congress on biotechology (2011) retrieved from internet www.omicsonline.org/biotechnology2011.
UniProtKB Accession No. P26951 accessed Oct. 27, 2015 from <http://www.uniprot.org/uniprot/P26951>.
Walter et al, "Clonal Architecture of Secondary Acute Myeloid Leukemia" The New England Journal of Medicine (2012) vol. 366 No. 12 pp. 1090-1098.
Weissman, "Paths to Cancer Therapies and Regerative Medicine," JAMA (2005) vol. 294 pp. 1359-1366.
Welch et al. "The origin and evolution of mutations in Acute Myeloid Leukemia" Cell (2012) vol. 150 No. 2 pp. 264-278.
Wunderlich et al, "AML xenograft efficiency is significantly improved in NOD/SCID-IL2RG mice constitutively expressing human SCF, GM-CSF and IL-3" Leukemia (2010) vol. 24 pp. 1785-1788.
Yalcintepe et al, "Expression of interleukin-3 receptor subunits on defined subpopulations of acute myeloid leukemia blasts predicts the cytotoxicity of diphtheria toxin interleukin-3fusion protein against malignant progenitors that engraft in immunodeficient mice" Blood (2006), vol. 108 No. 10:3530-7.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Cao et al. "Development and Application of a Multiplexable Flow cytometry-Based Assay to Quantify Cell-Mediated Cytoslysis" Cytometry Part A (2010) vol. 77A pp. 534-545.
Du et al., "New Immunotoxins Targeting CD123, a Stem Cell Antigen on Acute Myeloid Leukemia Cells" J. Immunother. vol. 30, No. 6 pp. 607-613 (2007).
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible.costimulator, CD134, and CD137 (4-1BB) in series with signals from the TCR zeta chain," J. Immunol. 172: 104-113 (2004).

Finney et al., "Chimeric receptors providing both primary and costimulatory signaling in T cells from a single gene product," J. Immunol. 161: 2791-2797 (1998).
Friedmann-Morvinski et al., "Redirected primary T cells harboring a chimeric receptor require costimulation for their antigen-specific activation," Blood 105: 3087-3093 (2005).
Geiger et al., "Integrated src kinase and constimulatory activity enhances signal transduction through single-chain chimeric receptors in T lymphocytes," Blood 98(8): 2364-2371 (2001).
GenBan Acc. No. BAG36664.1 accessed Oct. 13, 2015 from http://www.ncbi.nlm.nih.gov/protein/BAG36664.1.
GenBank Acc. No. AAA62478.2 accessed Oct. 13, 2015 from http://www.ncbi.nlm.nih.gov/protein/AAA62478.2.
GenBank Accession No. M74782 accessed Oct. 27, 2015 from <http://www.ncbi.nlm.nih.gov/nuccore/M74782>.
Genbank Accession No. NM 005191 accessed Oct. 27, 2015 from <http://www.ncbi.nlm.nih.gov/nuccore/nm_005191>.
Genbank Accession No. NP 002174 accessed Oct. 27, 2015 from <http://www.ncbi.nlm.nih.gov/protein/NP_002174>.
Gill et al. "Preclinical targeting of human acute myeloid leukemia and myeloablation using chimeric antigen receptor-modified T cells", Blood (2014) vol. 123 No. 23 pp. 2343-2345.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Hong et al. "Initiating and Cancer-Propagating Cells in TEL-AML1-Associated Childhood Leukemia" Science (2008) vol. 319 pp. 336-339.
Imai et al., "Chimeric receptors with 4-1BB signaling capacity provoke potent cytotoxicity against acute lymphoblastic leukemia," Leukemia 18: 676-684 (2004).
International Search Report and Written Opinion for PCT/CN2014/090508 dated May 22, 2015.
International Search Report and Written Opinion from PCT/CN2014/084696, dated May 25, 2015.
International Search Report including Written Opinon for PCT/US2014/017328 dated Jun. 26, 2014.
Irving et al., "The cytoplasmic domain of the T cell receptor zeta chain is sufficient to couple to receptor-associated signal transduction pathways," Cell 64: 891-901 (1991).
Jin et al, "Monoclonal Antibody-Mediated Targeting of CD123, IL-3 Receptor a Chain, Eliminates Human Acute Myeloid Leukemic Stem Cells" Cell Stem Cell (2009) vol. 5 pp. 31-42.
Jordan et al, "The interleukin-3 receptor alpha chain is a unique marker for human acute myelogenous leukaemia stem cells," Leukaemia (2000) vol. 14 pp. 1777-1784.
Jordan et al. "Targeting Myeloid Leukemia Stem Cells" Cancer (2010) vol. 2 No. 31 31ps21.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kitamura et al. "Expression Cloning of the Human IL-3 Receptor cDNA Reveals a Shared Subunit for the Human IL-3 and GM-CSF Receptors" Cell (1991) vol. 66 pp. 1165-1174.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).

(56) References Cited

OTHER PUBLICATIONS

Kwon et al., "cDNA sequences of two inducible T-cell genes". Proc. Natl. Acad. Sci. U.S.A. 86(6): 1963-1967 (1989).
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Maher et al., "Human T lymphocyte cytotoxicity and proliferation directed by a single chimeric TCRzeta/CD28 receptor," Nat. Biotechnol. 20: 70-75 (2002).
Mardiros et al. "T cells expressing CD123-specific chimeric antigen receptors exhibit specific cytolytic effector functions and antitumor effects against human acute myeloid leukemia," Blood (2013) vol. 122 No. 18 pp. 3138-3148.
Mardiros et al., "CD123-Specific Chimeric Antigen Receptor Redirected T Cells Exhibit Potent Cytolytic Activity and Multiple Effector Functions Against Acute Myeloid Leukemia without Altering Normal Hematopoietic Colony Formation in Vitro" Blood 120(21): abstract 950 (2011).
McGuinness et al., "Anti-tumor activity of human T cells expressing the CC49-zeta chimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo" The American Society of Gene & Cell Therapy (2009) vol. 17 No. 8 pp. 1453-1464.
Miyamoto et al. "AML1yETO-expressing nonleukemic stem cells in acute myelogenous leukemia with 8;21 chromosomal translocation" PNAS (2000) vol. 97 No. 13 pp. 7521-7526.
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Munoz et al, "Interleukin-3 receptor chain (CD123) is widely expresssed in hematologic malignancies, Haematologica" (2001), vol. 86 pp. 1261-1269.
NCBI Reference Sequence NM_000734.3 accessed Oct. 27, 2015 from http://www.ncbi.nlm.nih.gov/nuccore/NM_000734.3.
Pang et al, "Human bone marrow hematopoietic stem cells are increased in frequency and myeloid-biased with age" PNAS (2011) vol. 108 No. 50 pp. 20012-20017.
Pizzitola et al, "Chimeric antigen receptors against CD33/CD123 antigens efficiently target primary acute myeloid.leukemia cells in vivo", Leukemia (2014) vol. 28 No. 8 pp. 1596-1605.
Porter et al. "Chimeric Antigen Receptor-Modified T Cells in Chronic Lymphoid Leukemia", The New England Journal of Medicine (2011) vol. 365 No. 8 pp. 725-733.
Radhika et al., "Targeting Leukemias by CD123 Specific Chimerica Antigen Receptor" Blood(ASH Annual Meeting Abstracts) 118(21): abstract 1908 (2011).
Romeo et al., "Cellular immunity to HIV activated by CD4 fused to T cell or Fc receptor polypeptides," Cell 64:1037-1046 (1991).
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(16-17): 1157-1165 (1997).
Nilsson et al, "Involvement and functional impairment of the CD34_CD38_Thy-1_hematopoietic stem cell pool in myelodysplastic syndromes with trisomy 8" Blood (2002) vol. 100 No. 1 pp. 259-267.

Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.
Paul, W.E. Fundamental Immunology, 3rd Edition, 1993, pp. 292-295.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric Antigen Receptor Therapy for B-cell Malignancies" Journal of Cancer (2011) vol. 2 pp. 331-332.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell ransfer" Nature Medicine (2005) vol. 11 No. 11 pp. 1230-1237.
Roederer, "T-cell dynamics of immunodeficiency" Nature Medicine (1995) vol. 1 No. 7 pp. 621-622.
Ruella et al. "Anti-CD123 Chimeric Antigen Receptor Redirected T Cells for Relapsed B-Cell Acute Lymphoblastic Leukemuia" Cytotherapy, vol. 16 No. 4 Suppl. S, (2014), p. s8.
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Baeksgaard & Sorensen, "Acute tumor lysis syndrome in solid tumors—a case report and review of the iterature" Cancer Chemotherapy Pharmacology (2003) vol. 51 pp. 187-192.
Bendig M.M. Humanization of rodent monoclonal antibodies by CDR grafting. Methods: A Companion to Methods in Enzymology, 1995; vol. 8, p. 83-93.

(56) References Cited

OTHER PUBLICATIONS

Bondanza et al. "Suicide gene therapy of graft-versus-host disease induced by central memory human T lymphocytes" Blood (2006) vol. 107 No. 5 pp. 1828-1836.

Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.

Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.

Brentjens et al., "Eradication of systemic B-cell tumors by genetically targeted human T lymphocytes co-stimulated by CD80 and interleukin-15" Nature Medicine (2003) vol. 9 No. 3 pp. 279-286.

Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.

Brocker and Karjalainen, "Signals through T Cell Receptor- Chain alone Are Insufficient to Prime Resting T Lymphocytes" J. Exp. Med. (1995) vol. 181 pp. 1653-1659.

Call & Wucherpfennig, "The T Cell Receptor: Critical Role of the Membrane Environment in Receptor Assembly and Function" Annu. Rev. Immunol. (2005) vol. 23 pp. 101-125.

Carpenito et al. "Control of large, established tumor xenografts with genetically retargeted human T cells containing CD28 and CD137 domains", Proc Natl Acad Sci USA (2009) vol. 106 pp. 3360-3365.

Casset F, et al. A peptide mimetic of an anti-CD4 monoclonal antibody by rational design. Biochemical and Biophysical Research Communications, 2003, vol. 307, p. 198-205.

Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.

Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.

Dropulic and June, "Gene-Based Immunotherapy for Human Immunodeficiency Virus Infection and Acquired Immunodeficiency Syndrome" Human Gene Therapy (2006) vol. 17 pp. 577-588.

Dull et al, "A Third-Generation Lentivirus Vector with a Conditional Packaging System" Journal of Virology (1998) vol. 12 No. 11 pp. 8463-8471.

Frey, N. "Genetically Engineered Lymphocyte Therapy in Treating Patients With B-Cell Leukemia or Lymphoma That is Resistant or Refractory to Chemotherapy" (2015) Clinical Trial NCT01029366.

Geiger & Jyothi, "Development and Application of Receptor-Modified T Lymphocytes for Adoptive Immunotherapy" Transfusion Medicine Reviews (2001) vol. 15 No. 1 pp. 21-34.

GenBank Accession No. NP_000725.1 accessed on Jan. 7, 2016 from http://www.ncbi.nlm.nih.gov/protein/NP_000725.

GenBank Accession No. NP_932170.1 accessed Jan. 7, 2016 from http://www.ncbi.nlm.nih.gov/protein/NP_932170.

Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.

Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.

Gribben et al., "Stem cell transplantation for indolent lymphoma and chronic lymphocytic leukemia" Biol Blood Marrow Transplant (2011) vol. 17 (1 Suppl): S63-S70.

Griffin, "Development and applications of surface-linked single chain antibodies against T-cell antigens" Journal of Immunological Methods (2001) vol. 248 pp. 77-90.

Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.

Hekele et al., "Growth Retardation of Tumors by Adoptive Transfer of Cytotoxic T Lymphocytes Reprogrammed by CD44V6-Specific SCFV:~-Chimera" Int J. Cancer (1996) vol. 68 pp. 232-238.

Ho et al., "Adoptive immunotherapy: Engineering T cell responses as biological weapons for tumor mass destruction" Cancer Cell (2003) vol. 3 pp. 431-437.

Hollyman et al. "Manufacturing validation of biologically functional T cells targeted to CD19 antigen for autologous adoptive cell therapy" J Immunother (2009) vol. 32 No. 2 pp. 169-180.

Imai et al., "Genetic modification of primary natural killer cells overcomes inhibitory signals and induces specific killing of leukemic cells" Blood (2005) vol. 106 No. 1 pp. 376-383.

International Search Report and Written Opinion for PCT/CN2014/090505 dated May 6, 2015.

International Search Report for PCT/US2015/045898 dated Nov. 4, 2015.

International Search Report from PCT/US2011/064191 dated Jan. 5, 2012.

International Search Reporting and Written Opinion for PCT/CN2014/084695 dated May 21, 2015.

Jena, Bipulendu et al. "Redirecting T-cell specificity by introducing a tumor-specific chimeric antigen receptor, Blood, May 3, 2010", vol. 116, No. 7, pp. 1035-1044.

Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.

Johnson et al., "Gene therapy with human and mouse T-cell receptors mediates cancer regression and targets normal tissues expressing cognate antigen" Blood (2009) vol. 114 No. 3 pp. 535-545.

June et al., "Engineering lymphocyte subsets: tools, trials and tribulations" Nat Rev Immunol (2009) vol. 9 No. 10 pp. 704-716.

Kim et al., "Human 4-1BB regulates CD28 co-stimulation to promote Th1 cell responses" Eur. J. Immunol. (1998) vol. 28 pp. 881-890.

Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-Of-Hematology (ASH), Orlando, FL, USA; Dec. 4-7, 2010 abstract.

Kohn et al., "CARs on Track in the Clinic—Workshop of the Blood and Marrow Transplant Clinical Trials Network Subcommittee on Cell and Gene Therapy" Meeting Report—Molecular Therapy (2011) vol. 19 No. 3.

Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.

Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.

Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.

Lee et al., "In vivo Inhibition of Human CD19-Targeted Effector T Cells by Natural T Regulatory Cells in a Kenotransplant Murine Model of B Cell Malignancy" Cancer Research (2011) vol. 71 No. 8 pp. 2871-2881.

Levine et al., "Gene transfer in humans using a conditionally replicating lentiviral vector" PNAS (2006) vol. 103 No. 46 pp. 17372-17377.

Macallan et al., "Measurement and modeling of human T cell kinetics" European Journal of Immunology (2003) vol. 33 pp. 2316-2326.

(56) References Cited

OTHER PUBLICATIONS

MacCallum R.M. et al, Antibody-antigen interactions: Contact analysis and binding site topography. J. Mol. Bioi., 1998, vol. 262, p. 732-745.

Molina, "A Decade of Rituximab: Improving Survival Outcomes in Non-Hodgkin's Lymphoma" Annu. Rev. Med. (2008) vol. 59 pp. 237-250.

Morgan et al., "Case Report of a Serious Adverse Event Following the Administration of T Cells Transduced With a Chimeric Anitgen Receptor Recognizing ErbB2," Mol. Ther. 18(4): 843-851 (2010).

Moritz et al., "Cytotoxic T lymphocytes with a grafted recognition specificity for ERBB2-expressing tumor cells" Proc. Nat. Acad. Sci (1994) vol. 91 pp. 4318-4322.

Naldini et al., "In Vivo Gene Delivery and Stable Transduction of Nondividing Cells by a Lentiviral Vector" Science 1996) vol. 272 pp. 263-267.

\* cited by examiner

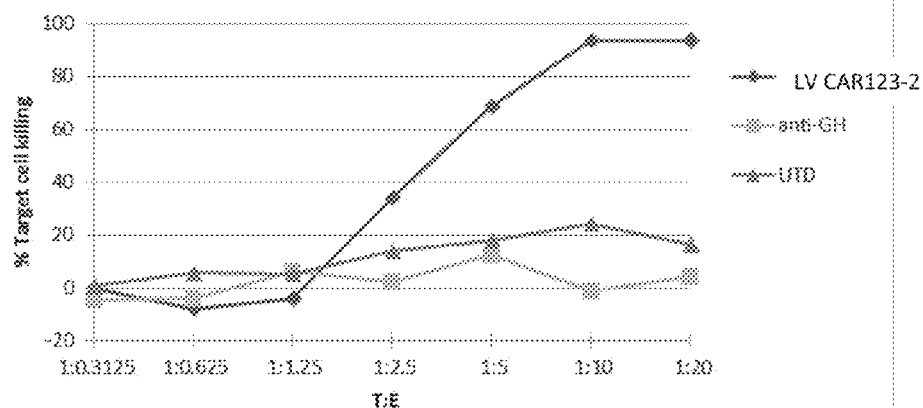
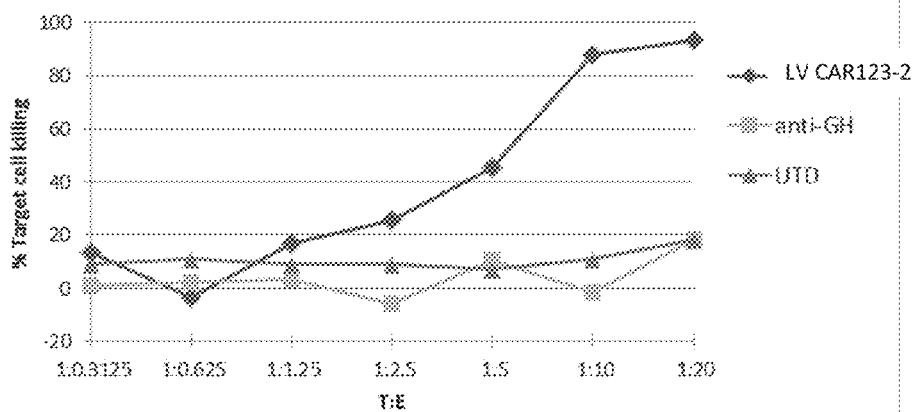
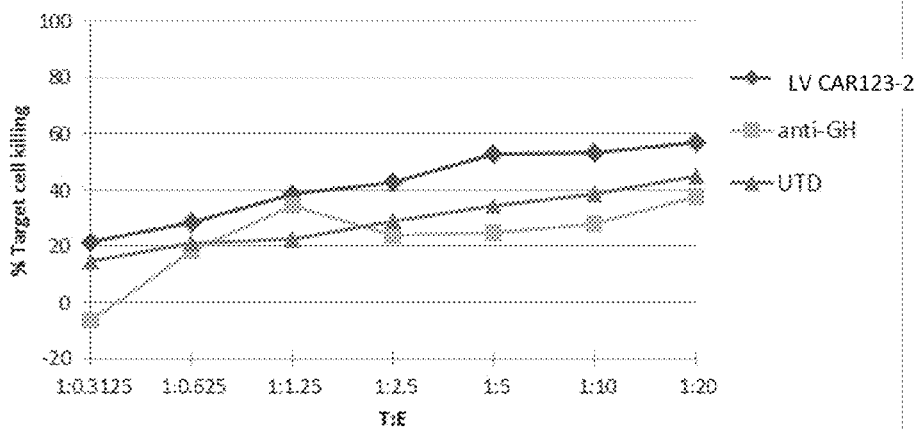

Untransduced T cells

RNA CD123-2 CART

Lentivirus CD123 tool CAR

RNA CD123 tool CAR

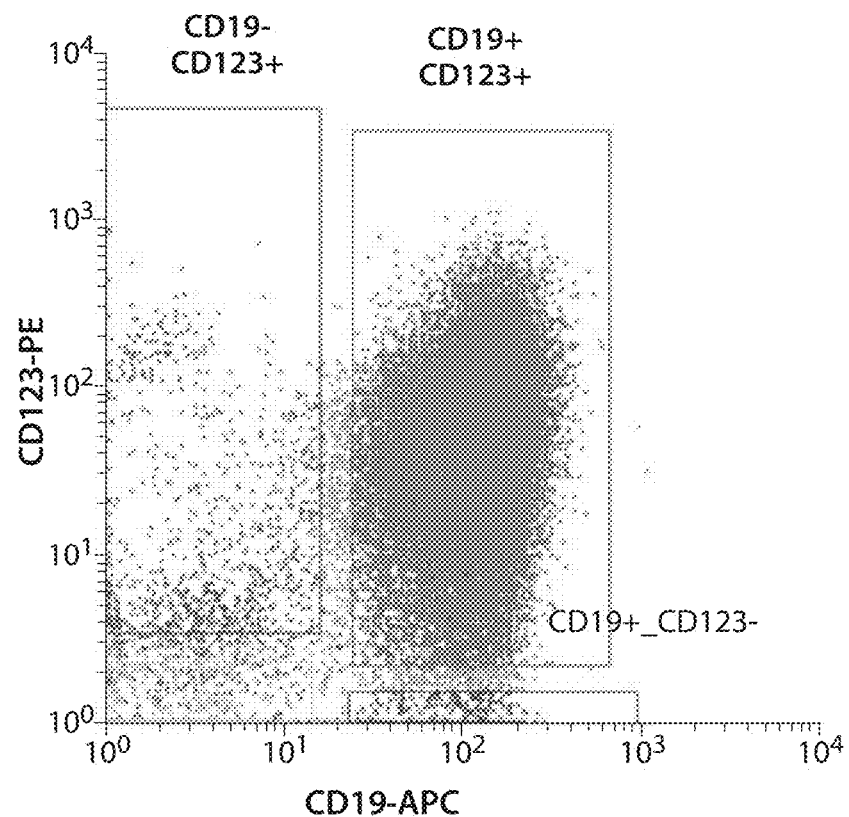
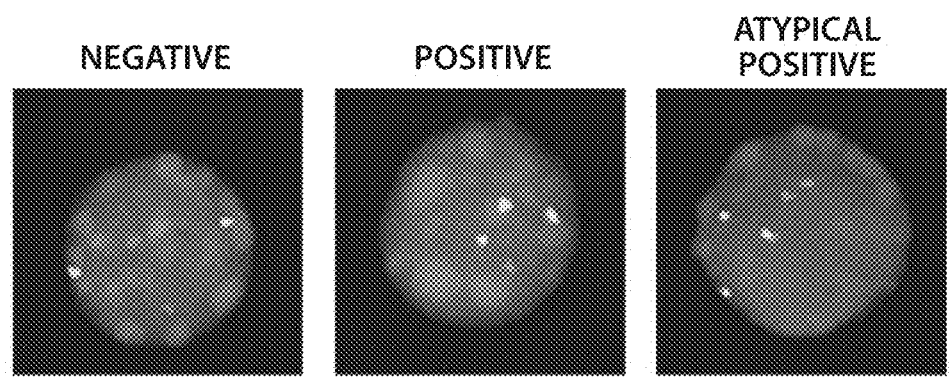
FIG. 31D

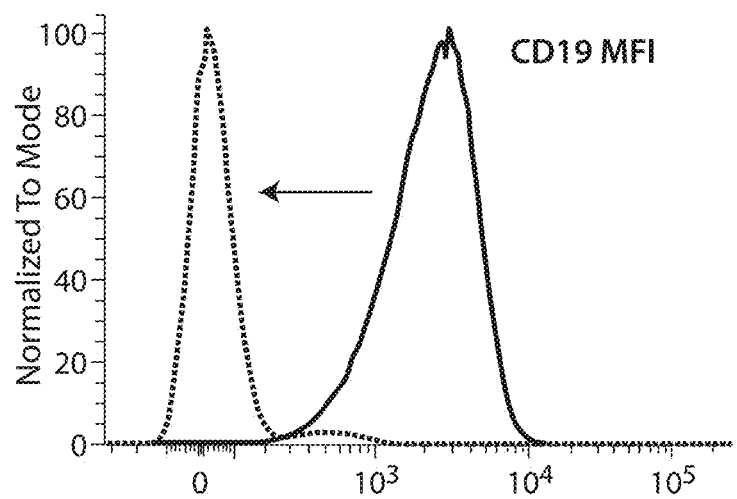
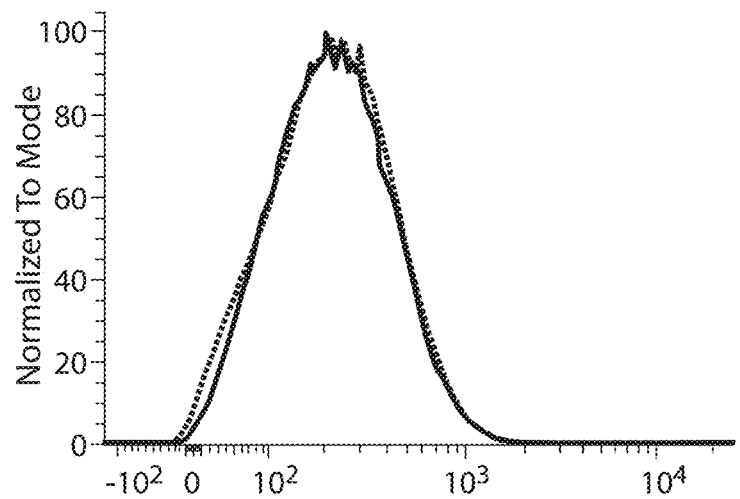
FIG. 31E

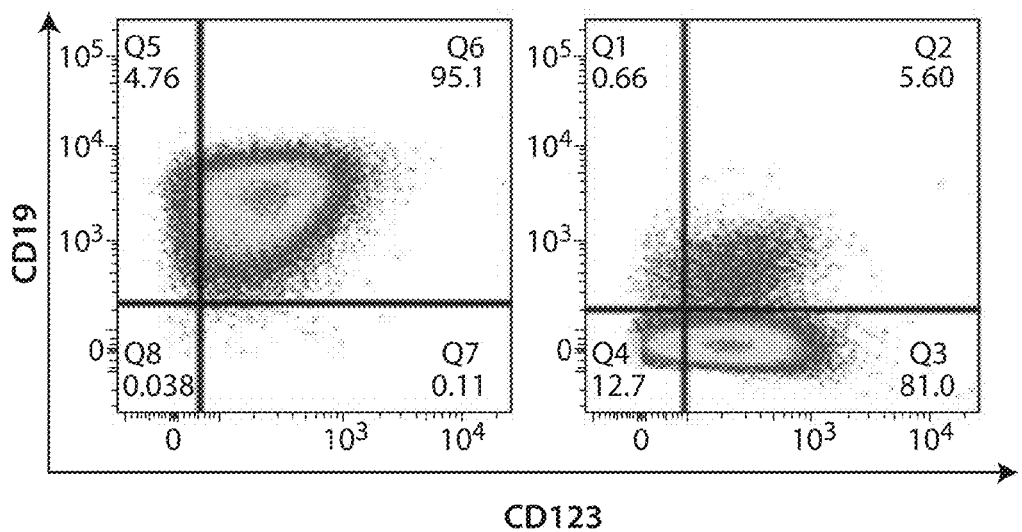
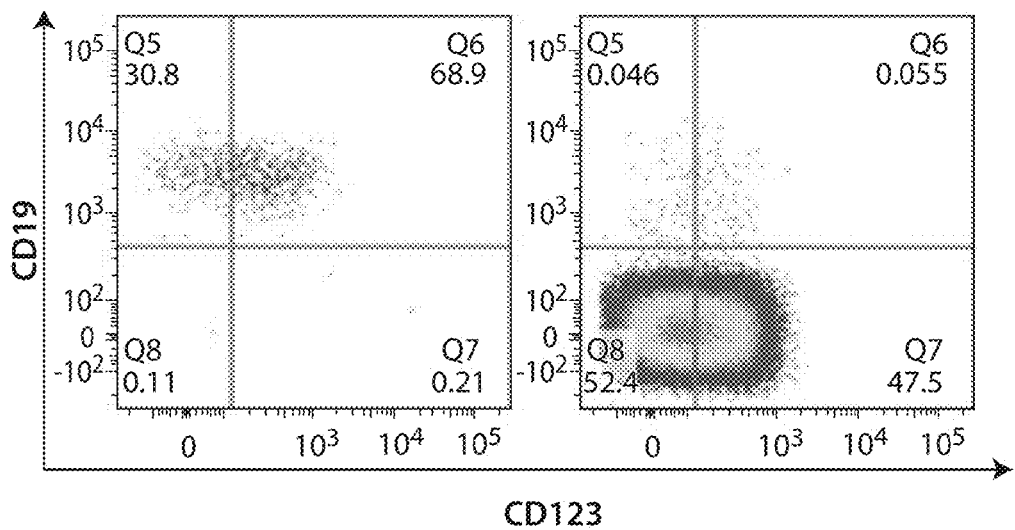
FIG. 38B

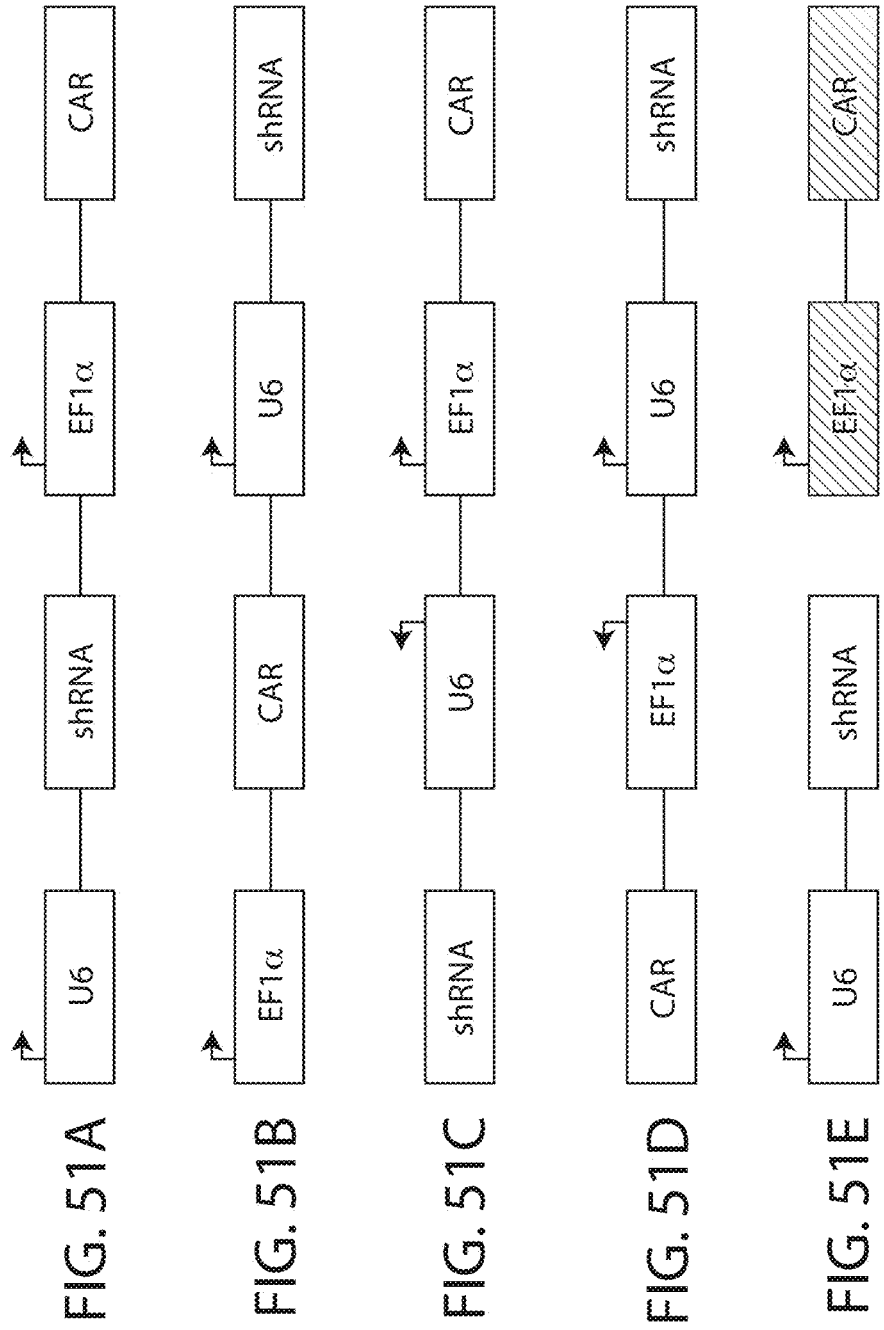

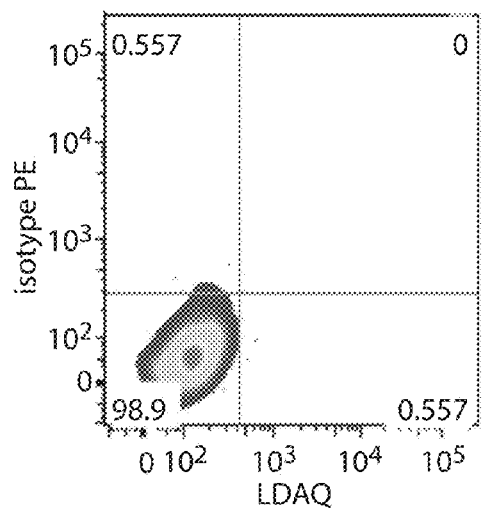
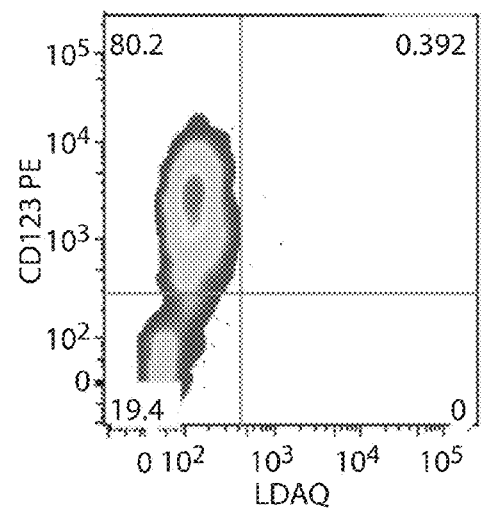
FIG. 68A    FIG. 68B
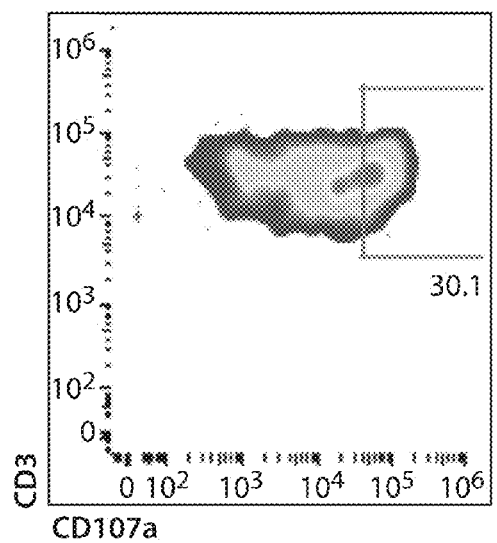
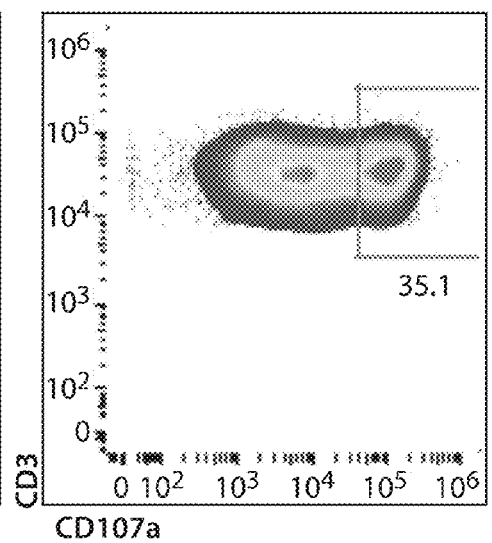
FIG. 69A    FIG. 69B

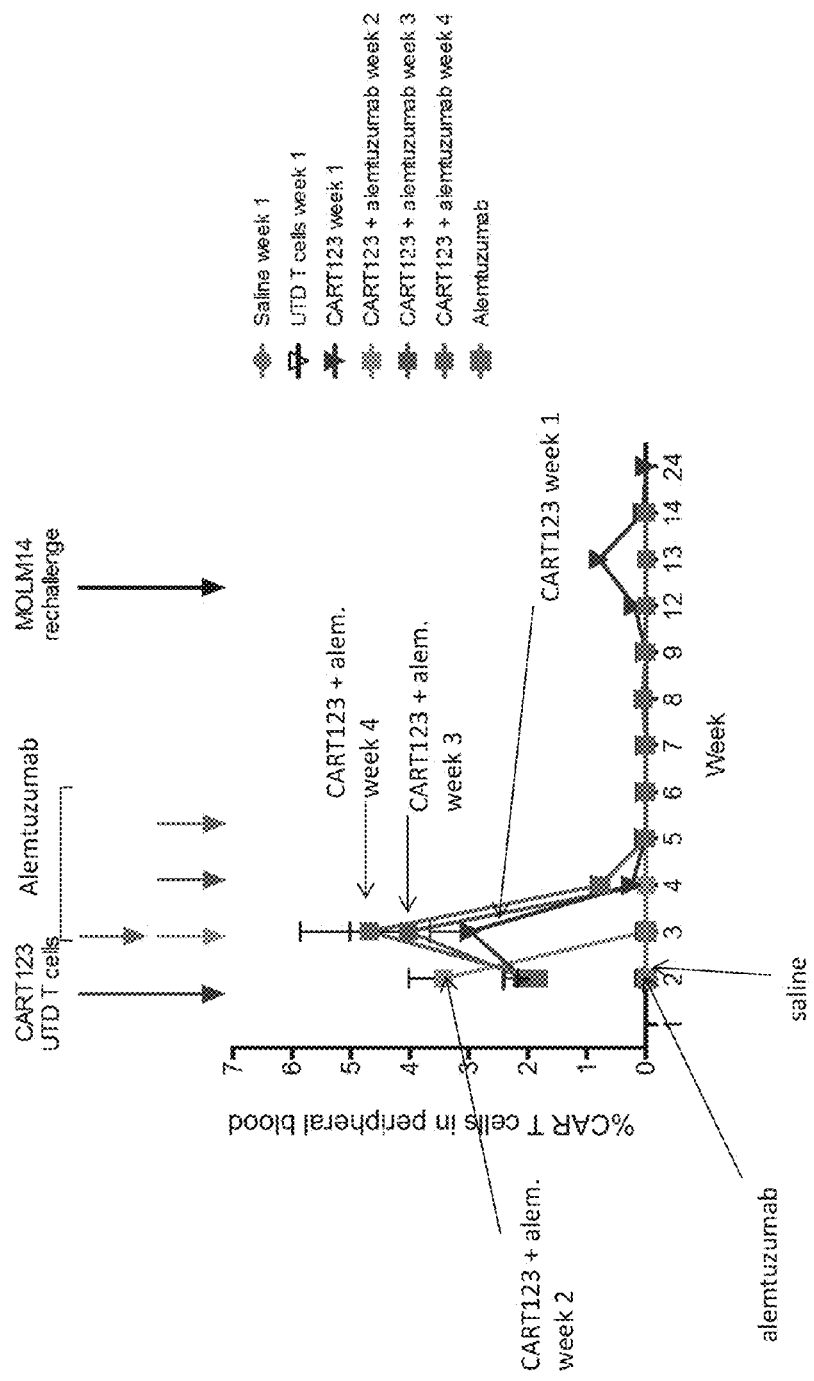

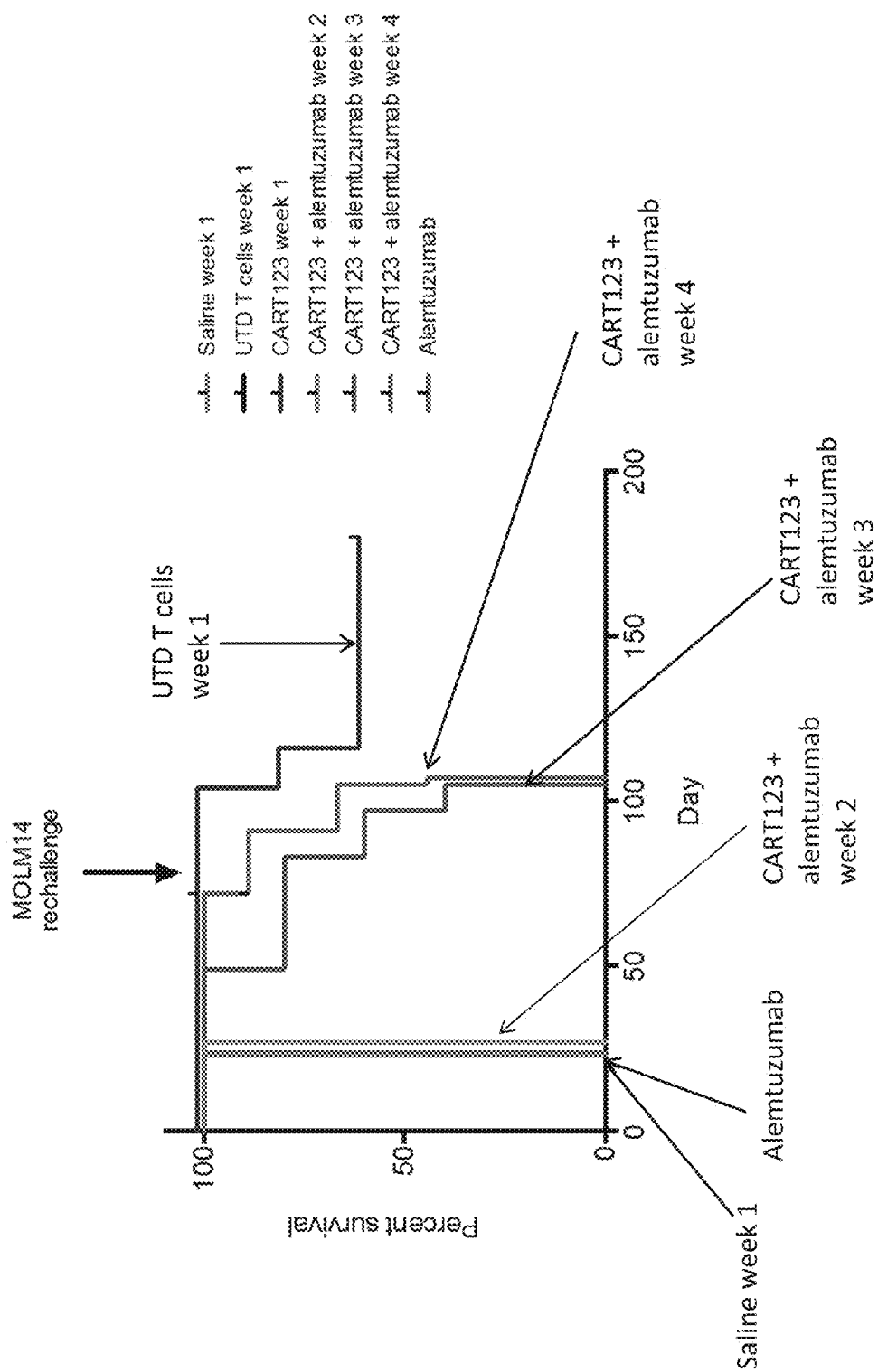

US 9,815,901 B2

TREATMENT OF CANCER USING A CD123 CHIMERIC ANTIGEN RECEPTOR

RELATED APPLICATIONS

This application claims priority to PCT Application No. PCT/CN2014/084696, filed Aug. 19, 2014, and PCT Application No. PCT/CN2014/090508, filed Nov. 6, 2014. The entire contents of each of these applications are incorporated herein by reference.

SEQUENCE LISTING

The instant application contains a Sequence Listing which has been submitted electronically in ASCII format and is hereby incorporated by reference in its entirety. Said ASCII copy, created on Aug. 18, 2015, is named N2067-7064WO5_SL.txt and is 625,588 bytes in size.

FIELD OF THE INVENTION

The present invention relates generally to the use of immune effectolls (e.g., T cells or NK cells) engineered to express a Chimeric Antigen Receptor (CAR) to treat a disease associated with expression of the Cluster of Differentiation 123 protein (CD123).

BACKGROUND OF THE INVENTION

Most patients with acute myeloid leukemia (AML) are incurable using standard therapy (Mrozek et al, 2012, J Clin Oncol, 30:4515-23) and those with relapsed or refractory AML (RR-AML) have a particularly poor prognosis (Kern et al, 2003, Blood 2003, 101:64-70; Wheatley et al, 1999, Br J Haematol, 107:69-79).

Genetic engineering can impart to T cells specificity toward a target of choice. T cells can be transduced with genetic material encoding a single chain variable fragment (scFv) of an antibody, in conjunction with a signaling molecule, thereby using the complementarity determining region (CDR) to recognize a cell surface antigen in a non-MHC restricted manner. These cells are termed chimeric antigen receptor (CAR) T cells. Preclinical and clinical attempts to target at least 20 different surface molecules in a variety of malignancies have shown some activity yet were often limited by poor persistence of the infused CAR T cell product (Sadelain et al, 2009, Curr Opin Immunol 2009, 21:215-23). Recent success with anti-CD19 redirected T cells in patients with advanced CLL and ALL (Porter et al, 2011, N Engl J Med, 365:725-33; Kalos et al, 2011, Science Transl Med, 3:95ra73; Grupp and Kalos, 2013, N Engl J Med, 368:1509-18) demonstrated that these cells can eradicate massive tumor burden after a single infusion with remission lasting up to 3 years to date, underscoring the dramatic potential of CAR T cell therapy. There have been few preclinical attempts to target AML in animal models (Marin et al, 2010, Haematologica, 95:2144-52; Tettamanti et al, 2013, Br J Haematol, 161:389-401) although a recently published small clinical trial demonstrated that it is feasible to produce and infuse T cells to patients with an aggressive malignancy (Ritchie et al, 2013, Mol Ther, 21:2122-9). Besides the ability for the chimeric antigen receptor on the genetically modified T cells to recognize and destroy the targeted cells, a successful therapeutic T cell therapy needs to have the ability to proliferate and persist over time, and to further monitor for relapse. T cells may be variably efficacious due to anergy, suppression or exhaustion but skilled practitioners have limited control over these features at this time. To be effective, CAR transformed patient T cells need to persist and maintain the ability to proliferate in response to antigen. It has been shown that ALL patient T cells perform can do this with CART19 comprising a murine scFv (see, e.g., Grupp et al., NEJM 368:1509-1518 (2013).

SUMMARY OF THE INVENTION

In a first aspect, the invention features an isolated nucleic acid molecule encoding a chimeric antigen receptor (CAR), wherein the CAR comprises a CD123 binding domain (e.g., a human or humanized CD123 binding domain), a transmembrane domain, and an intracellular signaling domain (e.g., an intracellular signaling domain comprising a costimulatory domain and/or a primary signaling domain). In one embodiment, the CAR comprises a CD123 binding domain described herein (e.g., a human or humanized CD123 binding domain described herein), a transmembrane domain described herein, and an intracellular signaling domain described herein (e.g., an intracellular signaling domain comprising a costimulatory domain and/or a primary signaling domain).

In one embodiment, the encoded CD123 binding domain comprises one or more (e.g., all three) light chain complementary determining region 1 (LC CDR1), light chain complementary determining region 2 (LC CDR2), and light chain complementary determining region 3 (LC CDR3) of a CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., a CD123 binding domain comprising one or more, e.g., all three, LC CDRs and one or more, e.g., all three, HC CDRs. In one embodiment, the encoded CD123 binding domain (e.g., a human or humanized CD123 binding domain) comprises a light chain variable region described herein (e.g., in Table 2, 6 or 9) and/or a heavy chain variable region described herein (e.g., in Table 2, 6 or 9). In one embodiment, the encoded CD123 binding domain is a scFv comprising a light chain and a heavy chain of an amino acid sequence of Table 2, 6 or 9. In an embodiment, the CD123 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 2, 6 or 9, or a sequence with 95-99% identity with an amino acid sequence of Table 2. 6 or 9; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 2, 6 or 9, or a sequence with 95-99% identity to an amino acid sequence of Table 2, 6 or 9.

In other embodiments, the encoded CD123 binding domain comprises a HC CDR1, a HC CDR2, and a HC CDR3 of any CD123 heavy chain binding domain amino acid sequences listed in Table 2, 6 or 9. In embodiments, the CD33 binding domain further comprises a LC CDR1, a LC CDR2, and a LC CDR3. In embodiments, the CD123 binding domain comprises a LC CDR1, a LC CDR2, and a LC CDR3 of any CD123 light chain binding domain amino acid sequences listed in Table 2, 6 or 9.

In some embodiments, the encoded CD123 binding domain comprises one, two or all of LC CDR1, LC CDR2, and LC CDR3 of any CD123 light chain binding domain amino acid sequences listed in Table 2 or 9, and one, two or all of HC CDR1, HC CDR2, and HC CDR3 of any CD123 heavy chain binding domain amino acid sequences listed in Table 2, 6 or 9.

In one embodiment, the encoded CD123 binding domain comprises an amino acid sequence selected from a group consisting of SEQ ID NO:157-160, 184-215, 478, 480, 483, and 485. In an embodiment, the encoded CD123 binding domain (e.g., an scFv) comprises an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of 157-160, 184-215, 478, 480, 483, and 485, or a sequence with 95-99% identity with an amino acid sequence of SEQ ID NO: 157-160, 184-215, 478, 480, 483, and 485.

In another embodiment, the encoded CD123 binding domain comprises a heavy chain variable region comprising an amino acid sequence selected from the group consisting of SEQ ID NO: 216-219 or 243-274, or an amino acid sequence having at least one, two or three modifications (e.g., substitutions, e.g., conservative substitutions) but not more than 30, 20 or 10 modifications (e.g., substitutions, e.g., conservative substitutions) of SEQ ID NO: 216-219 or 243-274, or a sequence with 95-99% identity to SEQ ID NO: 216-219 or 243-274. In another embodiment, the encoded CD123 binding domain comprises a heavy chain variable region comprising an amino acid sequence corresponding to the heavy chain variable region of SEQ ID NO:478, 480, 483, or 485, or an amino acid sequence having at least one, two or three modifications (e.g., substitutions, e.g., conservative substitutions) but not more than 30, 20 or 10 modifications (e.g., substitutions, e.g., conservative substitutions) of the corresponding portion of SEQ ID NO:478, 480, 483, or 485, or a sequence with 95-99% identity to the corresponding portion of SEQ ID NO:478, 480, 483, or 485.

In another embodiment, the encoded CD123 binding domain comprises a light chain variable region comprising an amino acid sequence selected from the group consisting of SEQ ID NO: 275-278 or 302-333, or an amino acid sequence having at least one, two or three modifications (e.g., substitutions, e.g., conservative substitutions) but not more than 30, 20 or 10 modifications (e.g., substitutions, e.g., conservative substitutions) of SEQ ID NO: 275-278 or 302-333, or a sequence with 95-99% identity to SEQ ID NO: 275-278 or 302-333. In another embodiment, the encoded CD123 binding domain comprises a light chain variable region comprising an amino acid sequence corresponding to the light chain variable region of SEQ ID NO:478, 480, 483, or 485, or an amino acid sequence having at least one, two or three modifications (e.g., substitutions, e.g., conservative substitutions) but not more than 30, 20 or 10 modifications (e.g., substitutions, e.g., conservative substitutions) of the corresponding portion of SEQ ID NO:478, 480, 483, or 485, or a sequence with 95-99% identity to the corresponding portion of SEQ ID NO:478, 480, 483, or 485.

In one embodiment, the nucleic acid molecule encoding the scFv comprises a nucleotide sequence selected from the group consisting of SEQ ID NO: 479, 481, 482, 484, or a sequence with 95-99% identity thereof. In one embodiment, the nucleic acid molecule comprises a nucleotide sequence encoding the heavy chain variable region and/or the light chain variable region, wherein said nucleotide sequence comprises a portion of a nucleotide sequence selected from the group consisting of SEQ ID NO: 479, 481, 482, and 484, or a sequence with 95-99% identity thereof, corresponding to the heavy chain variable region and/or the light chain variable region. In one embodiment, the nucleic acid molecule comprises a nucleotide sequence encoding the heavy chain variable region and/or the light chain variable region, wherein the encoded amino acid sequence is selected from the group consisting of SEQ ID NO:157-160, or a sequence with 95-99% identity thereof. In one embodiment, the nucleic acid molecule encodes an scFv comprising an amino acid sequence selected from the group consisting of SEQ ID NO:184-215, or a sequence with 95-99% identity thereof. In one embodiment, the nucleic acid molecule comprises a sequence encoding the heavy chain variable region and/or the light chain variable region, wherein the encoded amino acid sequence is selected from the group consisting of SEQ ID NO:184-215, or a sequence with 95-99% identity thereof.

In one embodiment, the encoded CD123 binding domain includes a (Gly4-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

In one embodiment, the encoded CAR includes a transmembrane domain that comprises a transmembrane domain of a protein, e.g., a protein described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the encoded transmembrane domain comprises the sequence of SEQ ID NO: 6. In one embodiment, the encoded transmembrane domain comprises an amino acid sequence comprising at least one, two or three modifications but not more than 20, 10 or 5 modifications of the amino acid sequence of SEQ ID NO:6, or a sequence with 95-99% identity to an amino acid sequence of SEQ ID NO:6. In one embodiment, the nucleic acid sequence encoding the transmembrane domain comprises a nucleotide sequence of SEQ ID NO: 17, or a sequence with 95-99% identity thereof.

In one embodiment, the encoded CD123 binding domain is connected to the transmembrane domain by a hinge region, e.g., a hinge region described herein. In one embodiment, the encoded hinge region comprises SEQ ID NO:2, or a sequence with 95-99% identity thereof. In one embodiment, the nucleic acid sequence encoding the hinge region comprises a nucleotide sequence of SEQ ID NO: 13, or a sequence with 95-99% identity thereof.

In one embodiment, the isolated nucleic acid molecule further comprises a sequence encoding a costimulatory domain, e.g., a costimulatory domain described herein. In embodiments, the intracellular signaling domain comprises a costimulatory domain. In embodiments, the intracellular signaling domain comprises a primary signaling domain. In embodiments, the intracellular signaling domain comprises a costimulatory domain and a primary signaling domain.

In one embodiment, the encoded costimulatory domain is a functional signaling domain from a protein, e.g., described herein, e.g., selected from the group consisting of a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In one embodiment, the encoded costimulatory domain of 4-1BB comprises the amino acid sequence of SEQ ID NO:7. In one embodiment, the encoded costimulatory domain comprises an amino acid sequence having at least one, two or three modifications but not more than 20, 10 or 5 modifications of an amino acid sequence of SEQ ID NO:7, or a sequence with 95-99% identity to the amino acid sequence of SEQ ID NO:7. In one embodiment, the nucleic acid sequence encoding the costimulatory domain comprises the nucleotide sequence of SEQ ID NO:18, or a sequence with 95-99% identity thereof. In another embodiment, the encoded costimulatory domain of CD28 comprises the amino acid sequence of SEQ ID NO:43. In one embodiment, the encoded costimulatory domain comprises an amino acid sequence having at least one, two or three modifications but not more than 20, 10 or 5 modifications of an amino acid sequence of SEQ ID NO:43, or a sequence with 95-99% identity to an amino acid sequence of SEQ ID NO:43. In one embodiment, the nucleic acid sequence encoding the costimulatory domain of CD28 comprises the nucleotide sequence of SEQ ID NO:44, or a sequence with 95-99% identity thereof. In another embodiment, the encoded costimulatory domain of CD27 comprises the amino acid sequence of SEQ ID NO:8. In one embodiment, the encoded costimulatory domain comprises an amino acid sequence having at least one, two or three modifications but not more than 20, 10 or 5 modifications of an amino acid sequence of SEQ ID NO:8, or a sequence with 95-99% identity to an amino acid sequence of SEQ ID NO:8. In one embodiment, the nucleic acid sequence encoding the costimulatory domain of CD27 comprises the nucleotide sequence of SEQ ID NO:19, or a sequence with 95-99% identity thereof. In another embodiment, the encoded costimulatory domain of ICOS comprises the amino acid sequence of SEQ ID NO:45. In one embodiment, the encoded costimulatory domain of ICOS comprises an amino acid sequence having at least one, two or three modifications but not more than 20, 10 or 5 modifications of an amino acid sequence of SEQ ID NO:45, or a sequence with 95-99% identity to an amino acid sequence of SEQ ID NO:45. In one embodiment, the nucleic acid sequence encoding the costimulatory domain of ICOS comprises the nucleotide sequence of SEQ ID NO:46, or a sequence with 95-99% identity thereof.

In one embodiment, the isolated nucleic acid molecule further comprises a sequence encoding an intracellular signaling domain, e.g., an intracellular signaling domain described herein.

In some embodiments, the encoded primary signaling domain comprises a functional signaling domain of CD3 zeta. In embodiments, the functional signaling domain of CD3 zeta comprises the amino acid sequence of SEQ ID NO:9 (mutant CD3 zeta) or SEQ ID NO:10 (wild type human CD3 zeta), or a sequence with 95-99% identity thereof.

In one embodiment, the encoded intracellular signaling domain comprises a functional signaling domain of 4-1BB and/or a functional signaling domain of CD3 zeta. In one embodiment, the encoded intracellular signaling domain of 4-1BB comprises the sequence of SEQ ID NO: 7 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:7 and/or an amino acid sequence of SEQ ID NO:9 or SEQ ID NO:10, or a sequence with 95-99% identity to an amino acid sequence of SEQ ID NO:7 and/or an amino acid sequence of SEQ ID NO:9 or SEQ ID NO:10. In one embodiment, the encoded intracellular signaling domain comprises the sequence of SEQ ID NO:7 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain comprises the nucleotide sequence of SEQ ID NO:18, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of CD27 and/or a functional signaling domain of CD3 zeta. In one embodiment, the encoded intracellular signaling domain of CD27 comprises the amino acid sequence of SEQ ID NO:8 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:8 and/or an amino acid sequence of SEQ ID NO:9 or SEQ ID NO:10, or a sequence with 95-99% identity to an amino acid sequence of SEQ ID NO:8 and/or an amino acid sequence of SEQ ID NO:9 or SEQ ID NO:10. In one embodiment, the encoded intracellular signaling domain comprises the sequence of SEQ ID NO:8 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of CD27 comprises the nucleotide sequence of SEQ ID NO:19, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of CD28 and/or a functional signaling domain of CD3 zeta. In one embodiment, the encoded intracellular signaling domain of CD28 comprises the amino acid sequence of SEQ ID NO:43 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:43 and/or an amino acid sequence of SEQ ID NO:9 or SEQ ID NO:10, or a sequence with 95-99% identity to an amino acid sequence of SEQ ID NO:43 and/or an amino acid sequence of SEQ ID NO:9 or SEQ ID NO:10. In one embodiment, the encoded intracellular signaling domain comprises the sequence of SEQ ID NO:43 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of CD28 comprises the nucleotide sequence of SEQ ID NO:44, or a sequence with 95-99% identity thereof, and/or the CD3 zeta nucleotide sequence of SEQ ID NO:20 or SEQ ID NO:21, or a sequence with 95-99% identity thereof.

In one embodiment, the encoded intracellular signaling domain comprises a functional signaling domain of ICOS and/or a functional signaling domain of CD3 zeta. In one embodiment, the encoded intracellular signaling domain of ICOS comprises the amino acid sequence of SEQ ID NO:45 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:45 and/or an amino acid sequence of SEQ ID NO:9 or SEQ ID NO:10, or a sequence with 95-99% identity to an amino acid sequence of SEQ ID NO:45 and/or an amino acid sequence of SEQ ID NO:9 or SEQ ID NO:10. In one embodiment, the encoded intracellular signaling domain comprises the sequence of SEQ ID NO:45 and the sequence of SEQ ID NO:9 or SEQ ID NO:10, wherein the sequences comprising the intracellular signaling domain are expressed in the same frame and as a single polypeptide chain. In one embodiment, the nucleic acid sequence encoding the intracellular signaling domain of ICOS comprises the nucleotide sequence of SEQ ID NO:46, or a sequence with 95-99% identity thereof, and/or the CD3 zeta nucleotide sequence of SEQ ID NO:20 or SEQ ID NO:21, or a sequence with 95-99% identity thereof.

In another aspect, the invention pertains to an isolated nucleic acid molecule encoding a CAR construct comprising a leader sequence, e.g., a leader sequence described herein, e.g., the amino acid sequence of SEQ ID NO: 1; a CD123 binding domain described herein, e.g., a CD123 binding domain comprising a LC CDR1, a LC CDR2, a LC CDR3, a HC CDR1, a HC CDR2 and a HC CDR3 described herein, e.g., a human or humanized CD123 binding domain described in Table 2, 6 or 9, or a sequence with 95-99% identify thereof; a hinge region described herein, e.g., a hinge region comprising the amino acid sequence of SEQ ID NO:2; a transmembrane domain described herein, e.g., a transmembrane domain comprising the amino acid sequence of SEQ ID NO: 6; and an intracellular signaling domain, e.g., an intracellular signaling domain described herein. In one embodiment, the encoded intracellular signaling domain comprises a costimulatory domain, e.g., a costimulatory domain described herein (e.g., a 4-1BB costimulatory domain comprising the amino acid sequence of SEQ ID NO:7, or a CD27 costimulatory domain comprising the amino acid sequence of SEQ ID NO:8), and/or a primary signaling domain, e.g., a primary signaling domain described herein (e.g., a CD3 zeta stimulatory domain comprising a sequence of SEQ ID NO:9 or SEQ ID NO:10). In one embodiment, the isolated nucleic acid molecule encoding the CAR construct includes a leader sequence encoded by the nucleic acid sequence of SEQ ID NO:12, or a sequence with 95-99% identity thereto.

In one embodiment, the isolated nucleic acid molecule comprises (e.g., consists of) a nucleic acid encoding a CAR amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, or SEQ ID NO: 156; or an amino acid having one, two or three modifications (e.g., substitutions) but not more than 30, 20 or 10 modifications (e.g., substitutions, e.g., conservative substitutions) of an amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, or SEQ ID NO: 156; or an amino acid sequence having 85%, 90%, 95%, 96%, 97%, 98% or 99% identity to an amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, or SEQ ID NO: 156.

In one embodiment, the isolated nucleic acid molecule comprises (e.g., consists of) a nucleic acid sequence of SEQ ID NO:39, SEQ ID NO:40, SEQ ID NO:41, SEQ ID NO:42, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, or SEQ ID NO:97 or a nucleic acid sequence having 85%, 90%, 95%, 96%, 97%, 98% or 99% identity to a nucleic acid sequence of SEQ ID NO:39, SEQ ID NO:40, SEQ ID NO:41, SEQ ID NO:42, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, or SEQ ID NO:97.

In one aspect, the invention pertains to an isolated nucleic acid molecule encoding a CD123 binding domain, wherein the CD123 binding domain comprises one or more (e.g., all three) light chain complementary determining region 1 (LC CDR1), light chain complementary determining region 2 (LC CDR2), and light chain complementary determining region 3 (LC CDR3) of a CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., a human or humanized CD123 binding domain comprising one or more, e.g., all three, LC CDRs and one or more, e.g., all three, HC CDRs.

In other embodiments, the encoded CD123 binding domain comprises a HC CDR1, a HC CDR2, and a HC CDR3 of any CD123 heavy chain binding domain amino acid sequence listed in Table 2, 6 or 9. In embodiments, the CD123 binding domain further comprises a LC CDR1, a LC CDR2, and a LC CDR3. In embodiments, the CD123 binding domain comprises a LC CDR1, a LC CDR2, and a LC CDR3 of any CD123 light chain binding domain amino acid sequence listed in Table 2, 6 or 9.

In some embodiments, the encoded CD123 binding domain comprises one, two or all of LC CDR1, LC CDR2, and LC CDR3 of any CD123 light chain binding domain amino acid sequences listed in Table 2, 6 or 9, and one, two or all of HC CDR1, HC CDR2, and HC CDR3 of any CD123 heavy chain binding domain amino acid sequences listed in Table 2, 6 or 9.

In one embodiment, the encoded CD123 binding domain comprises a light chain variable region described herein (e.g., in SEQ ID NO: 275-278 or 302-333) and/or a heavy chain variable region described herein (e.g., in SEQ ID NO:216-219 or 243-274). In one embodiment, the encoded CD123 binding domain is a scFv comprising a light chain and a heavy chain of an amino acid sequence of in SEQ ID NO: 157-160, 184-215, 478, 480, 483 or 485. In an embodiment, the CD123 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions) of an amino acid sequence of a light chain variable region provided in SEQ ID NO: 275-278 or 302-333, or a sequence with 95-99% identity with an amino acid sequence of SEQ ID NO: 275-278 or 302-333; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 216-219 or 243-274, or a sequence with 95-99% identity to an amino acid sequence in SEQ ID NO: 216-219 or 243-274.

In one embodiment, the encoded CD123 binding domain comprises an amino acid sequence selected from a group consisting of SEQ ID NO:157, SEQ ID NO:158, SEQ ID NO:159, SEQ ID NO:160, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:478, SEQ ID NO:480, SEQ ID NO:483 and SEQ ID NO:485, or a sequence with 95-99% identify thereof. In one embodiment, the encoded CD123 binding domain is a scFv, and a light chain variable region comprising an amino acid sequence described herein, e.g., in Table 2, 6 or 9, is attached to a heavy chain variable region comprising an amino acid sequence described herein, e.g., in Table 2, 6 or 9, via a linker, e.g., a linker described herein. In one embodiment, the encoded CD123 binding domain includes a (Gly4-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region.

Polypeptides

In another aspect, the invention pertains to an isolated polypeptide molecule encoded by the nucleic acid molecule. In one embodiment, the isolated polypeptide molecule comprises a sequence selected from the group consisting of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, and SEQ ID NO: 156, or an amino acid sequence having at least one, two or three modifications (e.g., substitutions, e.g., conservative substitutions) but not more than 30, 20 or 10 modifications (e.g., substitutions, e.g., conservative substitutions) of any of the aforesaid sequences, or a sequence with 95-99% identity to any of the aforesaid sequences.

In another aspect, the invention pertains to an isolated chimeric antigen receptor (CAR) molecule (e.g., polypeptide) comprising a CD123 binding domain (e.g., a human or humanized antibody or antibody fragment that specifically binds to CD123), a transmembrane domain, and an intracellular signaling domain (e.g., an intracellular signaling domain comprising a costimulatory domain and/or a primary signaling domain). In one embodiment, the CAR comprises an antibody or antibody fragment which includes a CD123 binding domain described herein (e.g., a human or humanized antibody or antibody fragment that specifically binds to CD123 as described herein), a transmembrane domain described herein, and an intracellular signaling domain described herein (e.g., an intracellular signaling domain comprising a costimulatory domain and/or a primary signaling domain described herein).

In one embodiment, the CD123 binding domain comprises one or more (e.g., all three) light chain complementary determining region 1 (LC CDR1), light chain complementary determining region 2 (LC CDR2), and light chain complementary determining region 3 (LC CDR3) of a CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., a CD123 binding domain comprising one or more, e.g., all three, LC CDRs and one or more, e.g., all three, HC CDRs. In one embodiment, the CD123 binding domain comprises a light chain variable region described herein (e.g., in Table 2, 6 or 9)

and/or a heavy chain variable region described herein (e.g., in Table 2, 6 or 9). In one embodiment, the CD123 binding domain is a scFv comprising a light chain and a heavy chain of an amino acid sequence listed in Table 2, 6 or 9. In an embodiment, the CD123 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 2, 6 or 9, or a sequence with 95-99% identity with an amino acid sequence provided in Table 2, 6 or 9; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 2, 6 or 9, or a sequence with 95-99% identity to an amino acid sequence provided in Table 2, 6 or 9.

In other embodiments, the CD123 binding domain comprises a HC CDR1, a HC CDR2, and a HC CDR3 of any CD123 heavy chain binding domain amino acid sequences provided in Table 2, 6 or 9. In embodiments, the CD123 binding domain further comprises a LC CDR1, a LC CDR2, and a LC CDR3. In embodiments, the CD123 binding domain comprises a LC CDR1, a LC CDR2, and a LC CDR3) of any CD123 light chain binding domain amino acid sequences listed in Table 2, 6 or 9.

In some embodiments, the CD123 binding domain comprises one, two or all of LC CDR1, LC CDR2, and LC CDR3 of any CD123 light chain binding domain amino acid sequences listed in Table 2, 6 or 9, and one, two or all of HC CDR1, HC CDR2, and HC CDR3 of any CD123 heavy chain binding domain amino acid sequences listed in Table 2, 6 or 9.

In one embodiment, the CD123 binding domain comprises an amino acid sequence selected from a group consisting of SEQ ID NO:157, SEQ ID NO:158, SEQ ID NO:159, SEQ ID NO:160, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:478, SEQ ID NO:480, SEQ ID NO:483 and SEQ ID NO:485; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identity to any of the aforesaid sequences. In one embodiment, the CD123 binding domain is a scFv, and a light chain variable region comprising an amino acid sequence described herein, e.g., in Table 2, 6 or 9, is attached to a heavy chain variable region comprising an amino acid sequence described herein, e.g., in Table 2, 6 or 9, via a linker, e.g., a linker described herein. In one embodiment, the CD123 binding domain includes a (Gly4-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region.

In one embodiment, the isolated CAR molecule comprises a transmembrane domain of a protein, e.g., a protein described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO: 6. In one embodiment, the transmembrane domain comprises an amino acid sequence having at least one, two or three modifications (e.g., substitutions, e.g., conservative substitutions) but not more than 20, 10 or 5 modifications (e.g., substitutions, e.g., conservative substitutions) of an amino acid sequence of SEQ ID NO: 6, or a sequence with 95-99% identity to an amino acid sequence of SEQ ID NO: 6.

In one embodiment, the CD123 binding domain is connected to the transmembrane domain by a hinge region, e.g., a hinge region described herein. In one embodiment, the encoded hinge region comprises SEQ ID NO:2, or a sequence with 95-99% identity thereof.

In one embodiment, the isolated CAR molecule further comprises a sequence encoding a costimulatory domain, e.g., a costimulatory domain described herein.

In some embodiments, the intracellular signaling domain of the isolated CAR molecule comprises a costimulatory domain. In embodiments, the intracellular signaling domain of the isolated CAR molecule comprises a primary signaling domain. In embodiments, the intracellular signaling domain of the isolated CAR molecule comprises a costimulatory domain and a primary signaling domain.

In one embodiment, the costimulatory domain comprises a functional signaling domain of a protein selected from the group consisting of a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In one embodiment, the costimulatory domain of 4-1BB comprises the sequence of SEQ ID NO:7. In one embodiment, the costimulatory domain comprises an amino acid sequence having at least one, two or three modifications (e.g., substitutions, e.g., conservative substitutions) but not more than 20, 10 or 5 modifications (e.g., substitutions, e.g., conservative substitutions) of an amino acid sequence of SEQ ID NO:7, or a sequence with 95-99% identity to an amino acid sequence of SEQ ID NO:7. In another embodiment, the costimulatory domain of CD28 comprises the amino acid sequence of SEQ ID NO:43. In one embodiment, the costimulatory domain comprises an amino acid sequence having at least one, two or three modifications but not more than 20, 10 or 5 modifications of an amino acid sequence of SEQ ID NO:43, or a sequence with 95-99% identity to an amino acid sequence of SEQ ID NO:43. In another embodiment, the costimulatory domain of CD27 comprises the amino acid sequence of SEQ ID NO:8. In one embodiment, the costimulatory domain comprises an amino acid sequence having at least one, two or three modifications but not more than 20, 10 or 5 modifications of an amino acid sequence of SEQ ID NO:8, or a sequence with 95-99% identity to an amino acid sequence of SEQ ID NO:8. In another embodiment, the costimulatory domain of ICOS comprises the amino acid sequence of SEQ ID NO:45. In one embodiment, the costimulatory domain comprises an amino acid sequence having at least one, two or three modifications, but not more than 20, 10 or 5 modifications of an amino acid sequence of SEQ ID NO:45, or a sequence with 95-99% identity to an amino acid sequence of SEQ ID NO:45.

In embodiments, the primary signaling domain comprises a functional signaling domain of CD3 zeta. In embodiments, the functional signaling domain of CD3 zeta comprises SEQ ID NO:9 (mutant CD3 zeta) or SEQ ID NO:10 (wild type human CD3 zeta), or a sequence with 95-99% identity thereof.

In one embodiment, the intracellular signaling domain comprises a functional signaling domain of 4-1BB and/or a functional signaling domain of CD3 zeta. In one embodiment, the intracellular signaling domain comprises the amino acid sequence of SEQ ID NO: 7 and/or the amino acid sequence of SEQ ID NO:9 or SEQ ID NO:10. In one embodiment, the intracellular signaling domain comprises an amino acid sequence having at least one, two or three modifications (e.g., substitutions, e.g., conservative substitutions) but not more than 20, 10 or 5 modifications (e.g., substitutions, e.g., conservative substitutions) of the amino acid sequence of SEQ ID NO: 7 and/or the amino acid sequence of SEQ ID NO:9 or SEQ ID NO:10, or a sequence with 95-99% identity to the amino acid sequence of SEQ ID NO: 7 and/or the amino acid sequence of SEQ ID NO:9 or SEQ ID NO:10. In one embodiment, the intracellular signaling domain comprises the amino acid sequence of SEQ ID NO: 7 and/or the amino acid sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of CD27 and/or a functional signaling domain of CD3 zeta. In one embodiment, the intracellular signaling domain of CD27 comprises the amino acid sequence of SEQ ID NO: 8 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:8 and/or an amino acid sequence of SEQ ID NO:9 or SEQ ID NO:10, or a sequence with 95-99% identity to an amino acid sequence of SEQ ID NO:8 and/or an amino acid sequence of SEQ ID NO:9 or SEQ ID NO:10. In one embodiment, the intracellular signaling domain comprises the sequence of SEQ ID NO:8 and the sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of CD28 and/or a functional signaling domain of CD3 zeta. In one embodiment, the encoded intracellular signaling domain of CD28 comprises the amino acid sequence of SEQ ID NO:43 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:43 and/or an amino acid sequence of SEQ ID NO:9 or SEQ ID NO:10, or a sequence with 95-99% identity to an amino acid sequence of SEQ ID NO:43 and/or an amino acid sequence of SEQ ID NO:9 or SEQ ID NO:10. In one embodiment, the intracellular signaling domain comprises the sequence of SEQ ID NO:43 and the sequence of SEQ ID NO:9 or SEQ ID NO:10, wherein the sequences comprising the intracellular signaling domain are expressed in the same frame and as a single polypeptide chain.

In one embodiment, the intracellular signaling domain comprises a functional signaling domain of ICOS and/or a functional signaling domain of CD3 zeta. In one embodiment, the intracellular signaling domain of ICOS comprises the amino acid sequence of SEQ ID NO:45 and/or the CD3 zeta amino acid sequence of SEQ ID NO:9 or SEQ ID NO:10. In one embodiment, the intracellular signaling domain comprises an amino acid sequence having at least one, two or three modifications but not more than 20, 10 or 5 modifications of an amino acid sequence of SEQ ID NO:45 and/or an amino acid sequence of SEQ ID NO:9 or SEQ ID NO:10, or a sequence with 95-99% identity to an amino acid sequence of SEQ ID NO:381 and/or an amino acid sequence of SEQ ID NO:9 or SEQ ID NO:10. In one embodiment, the encoded intracellular signaling domain comprises the sequence of SEQ ID NO:45 and the sequence of SEQ ID NO:9 or SEQ ID NO:10, wherein the sequences comprising the intracellular signaling domain are expressed in the same frame and as a single polypeptide chain.

In one embodiment, the isolated CAR molecule further comprises a leader sequence, e.g., a leader sequence described herein. In one embodiment, the leader sequence comprises the amino acid sequence of SEQ ID NO: 1, or a sequence with 95-99% identity to an amino acid sequence of SEQ ID NO:1.

In another aspect, the invention pertains to an isolated CAR molecule comprising a leader sequence, e.g., a leader sequence described herein, e.g., a leader sequence of SEQ ID NO: 1, or having 95-99% identity thereof, a CD123 binding domain described herein, e.g., a CD123 binding domain comprising a LC CDR1, a LC CDR2, a LC CDR3, a HC CDR1, a HC CDR2 and a HC CDR3 described herein, e.g., a CD123 binding domain described in Table 2 or 6, or a sequence with 95-99% identify thereof, a hinge region, e.g., a hinge region described herein, e.g., a hinge region of SEQ ID NO:2, or having 95-99% identity thereof, a transmembrane domain, e.g., a transmembrane domain described herein, e.g., a transmembrane domain having a sequence of SEQ ID NO:6 or a sequence having 95-99% identity thereof, an intracellular signaling domain, e.g., an intracellular signaling domain described herein (e.g., an intracellular signaling domain comprising a costimulatory domain and/or a primary signaling domain). In one embodiment, the intracellular signaling domain comprises a costimulatory domain, e.g., a costimulatory domain described herein, e.g., a 4-1BB costimulatory domain having a sequence of SEQ ID NO:7, or having 95-99% identity thereof, and/or a primary signaling domain, e.g., a primary signaling domain described herein, e.g., a CD3 zeta stimulatory domain having a sequence of SEQ ID NO:9 or SEQ ID NO:10, or having 95-99% identity thereof. In one embodiment, the intracellular signaling domain comprises a costimulatory domain, e.g., a costimulatory domain described herein, e.g., a 4-1BB costimulatory domain having a sequence of SEQ ID NO:7, and/or a primary signaling domain, e.g., a primary signaling domain described herein, e.g., a CD3 zeta stimulatory domain having a sequence of SEQ ID NO:9 or SEQ ID NO:10.

In one embodiment, the isolated CAR molecule comprises (e.g., consists of) an amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, and SEQ ID NO: 156, or an amino acid sequence having at least one, two, three, four, five, 10, 15, 20 or 30 modifications (e.g., substitutions, e.g., conservative substitutions) but not more than 60, 50 or 40 modifications (e.g., substitutions, e.g., conservative substitutions) of an amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, and SEQ ID NO: 156, or an amino acid sequence having 85%, 90%, 95%, 96%, 97%, 98% or 99% identity to an amino acid sequence of SEQ ID NO: 98, SEQ ID NO: 99, SEQ ID NO: 100, SEQ ID NO: 101, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, and SEQ ID NO: 156.

In one aspect, the invention pertains to a CD123 binding domain comprising one or more (e.g., all three) light chain complementary determining region 1 (LC CDR1), light chain complementary determining region 2 (LC CDR2), and light chain complementary determining region 3 (LC CDR3) of a CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a CD123 binding domain described herein, e.g., a CD123 binding domain comprising one or more, e.g., all three, LC CDRs and one or more, e.g., all three, HC CDRs (e.g., one, two or three HC CDRs according to Tables 3, 7, 10 or 12; and/or one, two or three LC CDRs according to Tables 4, 8, 11 or 13).

In other embodiments, the CD123 binding domain comprises a HC CDR1, a HC CDR2, and a HC CDR3 of any CD123 heavy chain binding domain amino acid sequences listed in Table 2, 6 or 9. In embodiments, the CD123 binding domain further comprises a LC CDR1, a LC CDR2, and a LC CDR3. In embodiments, the CD123 binding domain comprises a LC CDR1, a LC CDR2, and a LC CDR3) of any CD123 light chain binding domain amino acid sequences listed in Table 2, 6 or 9.

In some embodiments, the CD123 binding domain comprises one, two or all of LC CDR1, LC CDR2, and LC CDR3 of any CD123 light chain binding domain amino acid sequences listed in Table 2, 6 or 9, and one, two or all of HC CDR1, HC CDR2, and HC CDR3 of any CD123 heavy chain binding domain amino acid sequences listed in Table 2, 6 or 9.

In one embodiment, the CD123 binding domain comprises a light chain variable region described herein (e.g., in SEQ ID NO:275-278 or 302-333) and/or a heavy chain variable region described herein (e.g. in SEQ ID NO:216-219 or 243-274). In one embodiment, the CD123 binding domain is a scFv comprising a light chain and a heavy chain of an amino acid sequence of SEQ ID NO:157-160, 184-215, 478, 480, 483 or 485. In an embodiment, the CD123 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided, in SEQ ID NO: 275-278 or 302-333 or a sequence with 95-99% identity with an amino acid sequence in SEQ ID NO: 275-278 or 302-333; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in SEQ ID NO: 216-219 or 243-274, or a sequence with 95-99% identity to an amino acid sequence in SEQ ID NO: 216-219 or 243-274.

In one embodiment, the CD123 binding domain comprises a sequence selected from a group consisting of SEQ ID NO:157, SEQ ID NO:158, SEQ ID NO:159, SEQ ID NO:160, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:478, SEQ ID NO:480, SEQ ID NO:483, and SEQ ID NO:485, or a sequence with 95-99% identify thereof. In one embodiment, the CD123 binding domain is a scFv, and a light chain variable region comprising an amino acid sequence described herein, e.g., in Table 2, 6 or 9, is attached to a heavy chain variable region comprising an amino acid sequence described herein, e.g., in Table 2, 6 or 9, via a linker, e.g., a linker described herein. In one embodiment, the CD123 binding domain includes a (Gly4-Ser)n linker, wherein n is 1, 2, 3, 4, 5, or 6, preferably 4 (SEQ ID NO: 26). The light chain variable region and heavy chain variable region of a scFv can be, e.g., in any of the following orientations: light chain variable region-linker-heavy chain variable region or heavy chain variable region-linker-light chain variable region.

Nucleic Acids, Vectors and Cells

The nucleic acid molecules described herein can be a DNA molecule, an RNA molecule, or a combination thereof. In one embodiment, the nucleic acid molecule is an mRNA encoding a CAR polypeptide as described herein. In other embodiments, the nucleic acid molecule is a vector that includes any of the aforesaid nucleic acid molecules.

In another aspect, the invention pertains to a vector comprising a nucleic acid molecule described herein, e.g., a nucleic acid molecule encoding a CAR described herein. In one embodiment, the vector is selected from the group consisting of a DNA molecule or an RNA molecule (e.g., a plasmid, a lentivirus vector, adenoviral vector, or a retrovirus vector).

In one embodiment, the vector is a lentivirus vector. In one embodiment, the vector further comprises a promoter. In one embodiment, the promoter is an EF-1 promoter. In one embodiment, the EF-1 promoter comprises a sequence of SEQ ID NO: 11. In another embodiment, the promoter is a PGK promoter, e.g., a truncated PGK promoter as described herein.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail described herein, (e.g., comprising about 150 adenosine bases (SEQ ID NO: 705)). In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

In another aspect, the invention pertains to a cell comprising a nucleic acid molecule or a vector, or expressing a CAR polypeptide as described herein. In one embodiment, the cell is a cell described herein, e.g., an immune effector cell (e.g., a human T cell or NK cell, e.g., a human T cell or NK cell as described herein, or a cell population thereof). In one embodiment, the human T cell is a CD8+ T cell. In some embodiments, the cell expresses the CAR nucleic acid or polypeptide, or at some point expressed the CAR nucleic acid or polypeptide (e.g., a transiently expressed CAR molecule).

In some embodiment, the cell (e.g., the CAR-expressing cell) described herein can further express another agent, e.g., an agent which enhances the activity of a CAR-expressing cell. For example, in one embodiment, the agent can be a chimeric molecule that comprises an inhibitory molecule or a domain thereof. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFRbeta), e.g., as described herein. In one embodiment, the chimeric molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFRbeta), or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In another aspect, the invention pertains to a method of making a cell, e.g., an immune effector cell. The method includes introducing into, e.g., transducing, the immune effector cell with a nucleic acid molecule described herein (e.g., an RNA molecule, e.g., an mRNA), or a vector comprising a nucleic acid molecule encoding a CAR, e.g., a CAR described herein.

The present invention also provides a method of generating a population of cells (e.g., RNA-engineered cells transiently expressing an exogenous RNA). The method includes introducing into the cell an RNA as described herein (e.g., an in vitro transcribed RNA or synthetic RNA; an mRNA sequence encoding a CAR polypeptide as described herein). In embodiments, the RNA expresses the CAR polypeptide transiently. In one embodiment, the cell is a cell as described herein, e.g., an immune effector cell (e.g., T cells or NK cells, or cell population).

Therapeutic Uses

In another aspect, the invention pertains to a method of providing an anti-tumor immunity in a mammal comprising administering to the mammal an effective amount of a cell expressing a CAR molecule, e.g., a cell expressing a CAR molecule described herein. In one embodiment, the cell is an autologous immune effector cell, e.g., T cell or NK cell. In one embodiment, the cell is an allogeneic immune effector cell, e.g., T cell or NK cell. In one embodiment, the mammal is a human, e.g., a patient with a hematologic cancer.

In another aspect, the invention pertains to a method of treating a mammal having a disease associated with expression of CD123 (e.g., a proliferative disease, a precancerous condition, or a non-cancer related indication associated with the expression of CD123). The method includes administering to the mammal an effective amount of the cells expressing a CAR molecule, e.g., a CAR molecule described herein. In one embodiment, the mammal is a human, e.g., a patient with a hematologic cancer.

In one embodiment, the disease is a disease described herein. In one embodiment, the disease associated with CD123 expression is chosen from: a proliferative disease such as a cancer or a malignancy; a precancerous condition such as a myelodysplasia, a myelodysplastic syndrome or a preleukemia; or a non-cancer related indication associated with expression of CD123. In one embodiment, the disease is a hematologic cancer. In other embodiments, the disease is chosen from one or more acute leukemias, including but not limited to, acute myeloid leukemia (AML), acute lymphoblastic leukemia (ALL), acute lymphoblastic B-cell leukemia (B-cell acute lymphoid leukemia, BALL), and acute lymphoblastic T-cell leukemia (T-cell acute lymphoid leukemia (TALL); myelodysplastic syndrome; a myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia; a chronic myeloid leukemia (CML); and a blastic plasmacytoid dendritic cell neoplasm. In other embodiments, the disease associated with CD123 expression, includes, but is not limited to, atypical and/or non-classical cancer, a malignancy, a precancerous condition or a proliferative disease expressing CD123; and a combination thereof.

In one embodiment, the disease is chosen from one or more of acute myeloid leukemia (AML), acute lymphoblastic leukemia (ALL), acute lymphoblastic B-cell leukemia (B-cell acute lymphoid leukemia, BALL), acute lymphoblastic T-cell leukemia (T-cell acute lymphoid leukemia (TALL), B-cell prolymphocytic leukemia, chronic lymphocytic leukemia, chronic myeloid leukemia (CML), hairy cell leukemia, Hodgkin lymphoma, a mast cell disorder, a histiocytic disorder, a myelodysplastic syndrome, a myeloproliferative neoplasm, a plasma cell myeloma, a blastic plasmacytoid dendritic cell neoplasm, or a combination thereof. In one embodiment, the disease is a leukemia, e.g., ALL (e.g., relapsing and refractory ALL) or AML. In other embodiments, the disease is a CD19-negative cancer, e.g., a CD19-negative relapsed cancer.

In some embodiments of any of the aforesaid methods, the cell, e.g., the population of immune effector cells, comprises a vector, e.g., a lentiviral vector, comprising a nucleic acid molecule encoding the CAR polypeptide as described herein.

In other embodiments of any of the aforesaid methods, the cell, e.g., the population of immune effector cells, comprises an mRNA encoding the CAR polypeptide as described herein. In one embodiment, the cell is a CAR-expressing population of RNA-engineered cells, e.g., a population of transiently expressing cells.

In some embodiments of any of the aforesaid methods, the method further includes administering one or more doses of a cell (e.g., an immune cell containing a CAR nucleic acid or CAR polypeptide as described herein), to a mammal (e.g., a mammal having a cancer, e.g., a hematologic cancer as described herein (e.g., AML or ALL)). In some embodiments, the one or more doses of CAR cells (e.g., CD123 CAR cells) comprises at least about $1\times10^6$, $5\times10^6$, $1\times10^7$, $2\times10^7$, $5\times10^7$, $1\times10^8$, $2\times10^8$, $5\times10^8$, $1\times10^9$, $2\times10^9$, or $5\times10^9$ cells.

In one embodiment, up to 10, 9, 8, 7, 6, 5, 4, 3, or 2 doses of cells are administered. In other embodiments, one, two, three, four, five or 6 doses of the cells are administered to the mammal, e.g., in a treatment interval of one, two, three, four or more weeks. In one embodiment, up to 6 doses are administered in two weeks. The doses may the same or different. In one embodiment, a lower dose is administered initially, followed by one or more higher doses. In one exemplary embodiment, the lower dose is about $1\times10^5$ to $1\times10^9$ cells/kg, or $1\times10^6$ to $1\times10^8$ cells/kg; and the higher dose is about $2\times10^5$ to $2\times10^9$ cells/kg or $2\times10^6$ to $2\times10^8$ cells/kg, followed by 3-6 doses of about $4\times10^5$ to $4\times10^9$ cells/kg, or $4\times10^6$ to $4\times10^8$ cells/kg.

In one embodiment, the one or more doses of the cells are administered after one or more lymphodepleting therapies, e.g., a lymphodepleting chemotherapy. In one embodiment, the lymphodepleting therapy includes a chemotherapy (e.g., cyclophosphamide).

In one embodiment, the one or more doses is followed by a cell transplant, e.g., an allogeneic hematopoietic stem cell transplant. For example, the allogeneic hematopoietic stem cell transplant occurs between about 20 to about 35 days, e.g., between about 23 and 33 days.

In some embodiments, the cell, e.g., the population of immune effector cells (e.g., cells expressing a CAR molecule described herein) is administered in combination with one or more therapeutic agents or procedures as described herein.

In one embodiment, the cell, e.g., the population of immune effector cells (e.g., cells expressing a CAR molecule described herein) is administered in combination with an agent that increases the efficacy of a cell expressing a CAR molecule, e.g., an agent described herein.

In one embodiment, the cell, e.g., the population of immune effector cells (e.g., cells expressing a CAR molecule described herein) is administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

In an embodiment this approach can be used to optimize the performance of CAR cells described herein in the subject. While not wishing to be bound by theory, it is believed that, in an embodiment, the performance of endogenous, non-modified immune effector cells, e.g., T cells, is improved. While not wishing to be bound by theory, it is believed that, in an embodiment, the performance of a CD123 CAR expressing cell is improved. In other embodiments, cells, e.g., T cells, which have, or will be engineered to express a CAR, can be treated ex vivo by contact with an amount of an mTOR inhibitor that increases the number of PD1 negative immune effector cells (e.g., T cells or NK cells), or increases the ratio of PD1 negative immune effector cells, e.g., T cells or NK cells/PD1 positive immune effector cells, e.g., T cells or NK cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the CAR cells are administered after a sufficient time, or sufficient dosing, of an mTOR inhibitor, such that the level of PD1 negative immune effector cells, e.g., T cells, or the ratio of PD1 negative immune effector cells, e.g., T cells or NK cells/PD1 positive immune effector cells, e.g., T cells or NK cells, has been, at least transiently, increased.

In an embodiment, the cell, e.g., immune effector cell (e.g., T cell or NK cell), to be engineered to express a CAR, is harvested after a sufficient time, or after sufficient dosing of the low, immune enhancing, dose of an mTOR inhibitor, such that the level of PD1 negative immune effector cells, e.g., T cells or NK cells, or the ratio of PD1 negative immune effector cells, e.g., T cells or NK cells/PD1 positive immune effector cells, e.g., T cells or NK cells, in the subject or harvested from the subject has been, at least transiently, increased.

In an embodiment, the invention provides an mTOR inhibitor for use in the treatment of a subject, wherein said mTOR inhibitor enhances an immune response of said subject, and wherein said subject has received, is receiving or is about to receive an immune effector cell that expresses a CD123 CAR as described herein.

In another embodiment, the cell, e.g., the population of immune effector cells (e.g., cells expressing a CAR molecule described herein) is administered in combination with an agent that ameliorates one or more side effect associated with administration of a cell expressing a CAR molecule, e.g., an agent described herein.

In one embodiment, the cell, e.g., the population of immune effector cells (e.g., cells expressing a CAR molecule described herein), is administered in combination with an agent that treats the disease associated with CD123, e.g., an agent described herein.

In one embodiment, the cell, e.g., the population of immune effector cells (e.g., cells expressing a CAR molecule described herein) is administered in combination with a second therapeutic agent or procedure chosen from one or more of chemotherapy, a targeted anti-cancer therapy, an oncolytic drug, a cytotoxic agent, a cytokine, surgical procedure, a radiation procedure, an agonist of a costimulatory molecule, an inhibitor of an immune checkpoint molecule, a vaccine, or a second CAR-based immunotherapy.

In one embodiment, the cell, e.g., the population of immune effector cells (e.g., cells expressing a CAR molecule described herein) is administered in combination with an agonist of a costimulatory molecule, e.g., an agonist of a costimulatory molecule chosen from one or more of a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In other embodiments, the cell, e.g., the population of immune effector cells (e.g., cells expressing a CAR molecule described herein) is administered in combination with an inhibitor of an immune checkpoint molecule chosen from one or more of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, TGFR (e.g., TGFR beta), or a combination thereof.

In one embodiment, the inhibitor of the immune checkpoint molecule or the agonist of the costimulatory molecule is an antibody molecule, e.g., a monospecific antibody molecule or a bispecific antibody molecule. For example, the cell, e.g., the population of immune effector cells, can be administered in combination with a PD-1 inhibitor, a TIM-3 inhibitor, a CEACAM-1 inhibitor, or a combination thereof. In one embodiment, the PD-1 inhibitor and the TIM-3 inhibitor are administered in combination. In other embodiments, the TIM-3 inhibitor and the CEACAM-1 inhibitor are administered in combination.

In some embodiments, the inhibitor of the immune checkpoint molecule is administered subsequent to the administration of the cell, e.g., the population of immune effector cells, e.g., about 3-7 days after the administration of the cell, e.g., the population of immune effector cells.

As described in the Examples herein, CAR123-expressing immune effector cells have been shown to be an effective treatment for CD19-negative relapses (e.g., CD19-negative B-ALL). Without being bound by theory, a combinatorial approach of CAR123- and CD19 inhibition (e.g., CAR19-expressing immune effector cells) can be used to treat CD19-positive disease, while retarding or preventing antigen-loss relapses.

Accordingly, in yet other embodiments of any of the aforesaid methods, the cell, e.g., the population of immune effector cells, is administered in combination with a CD19 inhibitor, e.g., a CD19 inhibitor as described herein.

In some embodiments, the CD19 inhibitor is a CD19 CAR-expressing cell or an anti-CD19 antibody molecule. In one embodiment, the disease is a leukemia, e.g., ALL (e.g., relapsing and refractory ALL). In other embodiments the disease is AML. In other embodiments, the disease is a CD19-negative cancer, e.g., a CD19-negative relapsed cancer.

Alternatively or in combination with any of the aforesaid methods, a method of preventing a CD19-negative relapse in a mammal, e.g., a human, is provided. The method includes administering an effective amount of a cell, e.g., a population of immune effector cells (e.g., cells expressing a CAR molecule described herein). In some embodiments, the method further includes administering a CD19 inhibitor, e.g., a CD19 CAR-expressing cell. In some embodiments, the disease is a leukemia, e.g., acute lymphoblastic leukemia (e.g., relapsing and refractory ALL), or AML.

In some embodiments, the cell, e.g., the population of immune effector cells, is administered before, simultaneously or concurrently, or after administration of the CD19 inhibitor. In one embodiment, the cell, e.g., the population of immune effector cells, is administered after administration of the CD19. In other embodiments, the cell, e.g., the population of immune effector cells, is administered concurrently with the CD19 inhibitor.

In some embodiments, the cell, e.g., the population of immune effector cells, expresses a CD19 CAR and the CD123 CAR (e.g., a CAR as described herein).

Without wishing to be bound by theory, certain leukemic cells (e.g., B-ALL basts) have been found to co-express CD19 and CD123, while hemapoietic stem cells (HSC) are typically CD123-positive (CD123+), but CD19-negative (CD19-). In order to target leukemic cells that co-express CD19 and CD123 (e.g., B-ALL basts) while sparing HSC, a split CAR can be used where the functional intracellular domains are separated between CAR19 and CAR123. Such CAR molecules would cause full activation of the immune cell preferentially when the target cells co-express CD19 and CD123 (e.g., B-ALL basts), as opposed to a cell that expresses one of CD19 or CD123 (e.g. HSCs).

Accordingly, in some embodiments, the CD19 CAR or CD123 CAR comprises a split intracellular signaling domain such that full activation of the cell, e.g., the population of immune effector cells, occurs when both the CD19 CAR and CD123 CAR bind to a target cell, e.g., a target CD19+CD123+ cell (e.g., a B-ALL blast cell), compared to activation when the CD19 CAR and CD123 CAR bind to a target cell that expresses one of CD19 or CD123 (e.g., a hematopoietic stem cell). In one embodiment, the CD123CAR comprises a costimulatory domain, e.g., 4-1BB signaling domain, and the CD19 CAR comprises a primary signaling domain, e.g., a CD3 zeta signaling domain. In other embodiments, the CD123CAR comprises a comprises a primary signaling domain, e.g., a CD3 zeta signaling domain, and the CD19 CAR comprises a costimulatory domain, e.g., 4-1BB signaling domain. The CD123CAR and the CD19 CAR may be optionally linked to, e.g., one or more peptide cleavage sites such as P2A.

In yet other embodiments, the methods disclosed herein further include administering a T cell depleting agent after treatment with the cell (e.g., an immune effector cell as described herein), thereby reducing (e.g., depleting) the CAR-expressing cells (e.g., the CD123CAR-expressing cells). Such T cell depleting agents can be used to effectively deplete CAR-expressing cells (e.g., CD123CAR-expressing cells) to mitigate toxicity.

For example, alternatively or in combination with the methods disclosed herein, a method of reducing (e.g., depleting) a CAR-expressing cell after a CAR therapy (e.g., a CAR123 therapy disclosed herein) is disclosed. The method includes administering to a mammal a T cell depleting agent, in an amount to reduce (e.g., deplete) the CAR-expressing cells. In some embodiments, the T cell depleting agent is administered after treatment of the mammal with a cell, e.g., a population of immune effector cells (e.g., a CAR-expressing population of cells), thereby reducing (e.g., depleting) the cell (e.g., the CAR-expressing cell).

In some embodiments, the method further includes transplanting a cell, e.g., a hematopoietic stem cell, or a bone marrow, into the mammal.

In some embodiments, the mammal has a leukemia, e.g., acute lymphoblastic leukemia.

In some embodiments, the T cell depleting agent is administered one, two, three, four, or five weeks after administration of the cell, e.g., the population of immune effector cells, described herein.

In one embodiment, the T cell depleting agent is an agent that depletes CAR-expressing cells, e.g., by inducing antibody dependent cell-mediated cytotoxicity (ADCC) and/or complement-induced cell death. For example, CAR-expressing cells described herein may also express an antigen (e.g., a target antigen) that is recognized by molecules capable of inducing cell death, e.g., ADCC or complement-induced cell death. For example, CAR expressing cells described herein may also express a target protein (e.g., a receptor) capable of being targeted by an antibody or antibody fragment. Examples of such target proteins include, but are not limited to, EpCAM, VEGFR, integrins (e.g., integrins αvβ3, α4, αI¾β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

In some embodiments, the CAR expressing cell co-expresses the CAR and the target protein, e.g., naturally expresses the target protein or is engineered to express the target protein. For example, the cell, e.g., the population of immune effector cells, can include a nucleic acid (e.g., vector) comprising the CAR nucleic acid (e.g., a CAR nucleic acid as described herein) and a nucleic acid encoding the target protein.

In one embodiment, the T cell depleting agent is a CD52 inhibitor, e.g., an anti-CD52 antibody molecule, e.g., alemtuzumab.

In other embodiments, the cell, e.g., the population of immune effector cells, expresses a CAR molecule as described herein (e.g., CD123CAR) and the target protein recognized by the T cell depleting agent. In one embodiment, the target protein is CD20. In embodiments where the target protein is CD20, the T cell depleting agent is an anti-CD20 antibody, e.g., rituximab.

In further embodiments of any of the aforesaid methods, the methods further include transplanting a cell, e.g., a hematopoietic stem cell, or a bone marrow, into the mammal.

In another aspect, the invention features a method of conditioning a mammal prior to cell transplantation. The method includes administering to the mammal an effective amount of the cell comprising the CAR nucleic acid as described herein, or the polypeptide as described herein. In some embodiments, the cell transplantation is a stem cell transplantation, e.g., a hematopoietic stem cell transplantation, or a bone marrow transplantation. In other embodiments, conditioning a subject prior to cell transplantation includes reducing the number of CD123-expressing cells in a subject, e.g., CD123-expressing normal cells or CD123-expressing cancer cells.

In another aspect, the invention pertains to the isolated nucleic acid molecule encoding a CAR of the invention, the isolated polypeptide molecule of a CAR of the invention, the vector comprising a CAR of the invention, and the cell comprising a CAR of the invention for use as a medicament, e.g., as described herein (e.g., for use in the treatment of a disease associated with expression of CD123).

In another aspect, the invention pertains to the isolated nucleic acid molecule encoding a CAR of the invention, the isolated polypeptide molecule of a CAR of the invention, the vector comprising a CAR of the invention, and the cell comprising a CAR of the invention for use in the treatment of a disease expressing CD123, e.g., a disease expressing CD123 as described herein. In certain embodiments, the disease is a hematologic cancer, e.g., as described herein. In some embodiments, the disease is chosen from: an acute leukemia, including but not limited to, acute myeloid leukemia (AML), acute lymphoblastic leukemia (ALL), acute lymphoblastic B-cell leukemia (B-cell acute lymphoid leukemia, BALL), and acute lymphoblastic T-cell leukemia (T-cell acute lymphoid leukemia (TALL); myelodysplastic syndrome; a myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia; a chronic myeloid leukemia (CML); or a blastic plasmacytoid dendritic cell neoplasm.

Additional features and embodiments of the aforesaid compositions and methods include one or more of the following:

In certain embodiments, the CD123 CAR molecule (e.g., a CD123 CAR nucleic acid or a CD123 CAR polypeptide as described herein), or the CD123 binding domain as described herein, includes one, two or three CDRs from the heavy chain variable region (e.g., HC CDR1, HC CDR2 and/or HC CDR3), provided in Table 3; and/or one, two or three CDRs from the light chain variable region (e.g., LC CDR1, LC CDR2 and/or LC CDR3) provided in Table 4 (e.g., one, two or three HC CDR1, HC CDR2 or HC CDR3, and/or one, two or three LC CDR1, LC CDR2 or LC CDR3, of CAR123-1, CAR123-2, CAR123-3, CAR123-4, provided in Table 3 or 4); or a sequence substantially identical (e.g., 95-99% identical, or up to 5, 4, 3, 2, or 1 amino acid changes, e.g., substitutions (e.g., conservative substitutions)) to any of the aforesaid sequences.

In certain embodiments, the CD123 CAR molecule (e.g., a CD123 CAR nucleic acid or a CD123 CAR polypeptide as described herein), or the anti-CD123 antigen binding domain as described herein, includes one, two or three CDRs from the heavy chain variable region (e.g., HC CDR1, HC CDR2 and/or HC CDR3), provided in Table 10; and/or one, two or three CDRs from the light chain variable region provided in Table 11 (e.g., one, two or three HC CDR1, HC CDR2 or HC CDR3, and/or one, two or three LC CDR1, LC CDR2 or LC CDR3, of CAR123-1, CAR123-2, CAR123-3, CAR123-4, provided in Table 10 or 11); or a sequence substantially identical (e.g., 95-99% identical, or up to 5, 4, 3, 2, or 1 amino acid changes, e.g., substitutions (e.g., conservative substitutions)) to any of the aforesaid sequences.

In certain embodiments, the CD123 CAR molecule, or the anti-CD123 antigen binding domain, includes one, two or three CDRs from the heavy chain variable region (e.g., HCDR1, HCDR2 and/or HCDR3), provided in Table 12; and/or one, two or three CDRs from the light chain variable region provided in Table 13 (e.g., one, two or three HC CDR1, HC CDR2 or HC CDR3, and/or one, two or three LC CDR1, LC CDR2 or LC CDR3, of CAR123-1, CAR123-2, CAR123-3, CAR123-4, provided in Table 12 or 13); or a sequence substantially identical (e.g., 95-99% identical, or up to 5, 4, 3, 2, or 1 amino acid changes, e.g., substitutions (e.g., conservative substitutions)) to any of the aforesaid sequences.

In certain embodiments, the CD123 CAR molecule, or the anti-CD123 antigen binding domain, includes
  (i) a LC CDR1, LC CDR2 and LC CDR3 of any CD123 light chain binding domain amino acid sequences listed in Table 2, 6 or 9, or the LC CDRs in Table 4, 8, 11 or 13; and/or.
  (ii) a HC CDR1, HC CDR2 and HC CDR3 of any CD123 heavy chain binding domain amino acid sequences listed in Table 2, 6 or 9, or the HC CDRs in Table 3, 7, 10 or 12.

In certain embodiments, the CD123 CAR molecule (e.g., a CD123 CAR nucleic acid or a CD123 CAR polypeptide as described herein), or the anti-CD123 antigen binding domain as described herein, includes:
(1) one, two or three light chain (LC) CDRs chosen from one of the following:
  (i) a LC CDR1 of SEQ ID NO:418, LC CDR2 of SEQ ID NO:446 and LC CDR3 of SEQ ID NO:474 of CAR123-1;
  (ii) a LC CDR1 of SEQ ID NO:419, LC CDR2 of SEQ ID NO:447 and LC CDR3 of SEQ ID NO:475 of CAR123-2;
  (iii) a LC CDR1 of SEQ ID NO:420, LC CDR2 of SEQ ID NO:448 and LC CDR3 of SEQ ID NO:476 of CAR123-3;
  (iv) a LC CDR1 of SEQ ID NO:421, LC CDR2 of SEQ ID NO:449 and LC CDR3 of SEQ ID NO:477 of CAR123-4; and/or
(2) one, two or three heavy chain (HC) CDRs chosen from one of the following:
  (i) a HC CDR1 of SEQ ID NO:334, HC CDR2 of SEQ ID NO:362 and HC CDR3 of SEQ ID NO: 390 of CAR123-1;
  (ii) a HC CDR1 of SEQ ID NO: 335, HC CDR2 of SEQ ID NO: 363 and HC CDR3 of SEQ ID NO: 391 of CAR123-2;
  (iii) a HC CDR1 of SEQ ID NO: 336, HC CDR2 of SEQ ID NO: 364 and HC CDR3 of SEQ ID NO: 392 of CAR123-3;
  (iv) a HC CDR1 of SEQ ID NO: 337, HC CDR2 of SEQ ID NO: 365 and HC CDR3 of SEQ ID NO: 393 of CAR123-4.

In certain embodiments, the CD123 CAR molecule (e.g., a CD123 CAR nucleic acid or a CD123 CAR polypeptide as described herein), or the anti-CD123 antigen binding domain as described herein, includes:
(1) one, two or three light chain (LC) CDRs chosen from one of the following:
  (i) a LC CDR1 of SEQ ID NO:501, LC CDR2 of SEQ ID NO: 506 and LC CDR3 of SEQ ID NO: 511 of CAR123-1;
  (ii) a LC CDR1 of SEQ ID NO: 502, LC CDR2 of SEQ ID NO: 507 and LC CDR3 of SEQ ID NO: 512 of CAR123-2;
  (iii) a LC CDR1 of SEQ ID NO: 503, LC CDR2 of SEQ ID NO: 508 and LC CDR3 of SEQ ID NO: 513 of CAR123-3;
  (iv) a LC CDR1 of SEQ ID NO: 504, LC CDR2 of SEQ ID NO: 509 and LC CDR3 of SEQ ID NO: 514 of CAR123-4; and/or
(2) one, two or three heavy chain (HC) CDRs chosen from one of the following:
  (i) a HC CDR1 of SEQ ID NO:486, HC CDR2 of SEQ ID NO:491 and HC CDR3 of SEQ ID NO: 496 of CAR123-1;
  (ii) a HC CDR1 of SEQ ID NO: 487, HC CDR2 of SEQ ID NO:492 and HC CDR3 of SEQ ID NO: 497 of CAR123-2;
  (iii) a HC CDR1 of SEQ ID NO: 488, HC CDR2 of SEQ ID NO:493 and HC CDR3 of SEQ ID NO: 498 of CAR123-3;
  (iv) a HC CDR1 of SEQ ID NO: 489, HC CDR2 of SEQ ID NO:494 and HC CDR3 of SEQ ID NO: 499 of CAR123-4.

In certain embodiments, the CD123 CAR molecule (e.g., a CD123 CAR nucleic acid or a CD123 CAR polypeptide as described herein), or the anti-CD123 antigen binding domain as described herein, includes:
(1) one, two or three light chain (LC) CDRs chosen from one of the following:
  (i) a LC CDR1 of SEQ ID NO:531, LC CDR2 of SEQ ID NO: 536 and LC CDR3 of SEQ ID NO: 541 of CAR123-1;
  (ii) a LC CDR1 of SEQ ID NO: 532, LC CDR2 of SEQ ID NO: 537 and LC CDR3 of SEQ ID NO: 542 of CAR123-2;
  (iii) a LC CDR1 of SEQ ID NO: 533, LC CDR2 of SEQ ID NO: 538 and LC CDR3 of SEQ ID NO: 543 of CAR123-3;
  (iv) a LC CDR1 of SEQ ID NO: 534, LC CDR2 of SEQ ID NO: 539 and LC CDR3 of SEQ ID NO: 544 of CAR123-4; and/or
(2) one, two or three heavy chain (HC) CDRs chosen from one of the following:
  (i) a HC CDR1 of SEQ ID NO:516, HC CDR2 of SEQ ID NO: 521 and HC CDR3 of SEQ ID NO: 526 of CAR123-1;
  (ii) a HC CDR1 of SEQ ID NO: 517, HC CDR2 of SEQ ID NO: 522 and HC CDR3 of SEQ ID NO: 527 of CAR123-2;
  (iii) a HC CDR1 of SEQ ID NO: 518, HC CDR2 of SEQ ID NO: 523 and HC CDR3 of SEQ ID NO: 528 of CAR123-3;

(iv) a HC CDR1 of SEQ ID NO: 519, HC CDR2 of SEQ ID NO: 524 and HC CDR3 of SEQ ID NO: 529 of CAR123-4.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another. Other features, objects, and advantages of the invention will be apparent from the description and drawings, and from the claims.

BRIEF DESCRIPTION OF THE DRAWINGS

The following detailed description of preferred embodiments of the invention will be better understood when read in conjunction with the appended drawings. For the purpose of illustrating the invention, there are shown in the drawings embodiments which are presently preferred. It should be understood, however, that the invention is not limited to the precise arrangements and instrumentalities of the embodiments shown in the drawings.

FIG. 5A shows transduction efficiency of T cells with 1172 and 1176. FIG. 5B shows transduction efficiency of T cells with CD123 CARs 2-4.

FIG. 19, comprising

FIG. 24A shows production of IL-2; FIG. 24B shows the production of IFN-gamma; and FIG. 24C shows the production of TNF-alpha.

FIGS. 26A, 26B, and 26C show the ability of lentivirally transduced T cells expressing CAR123 CAR (LV CAR123-2) or control (Anti-GH), or untransduced cells (UTD) to kill target cells at various target cell:effector cell ratios, where the target cells are CD123-expressing MOLM13 (FIG. 26A) or PL21 (FIG. 26B) cells, or CD123-negative U87 cells (FIG. 26C).

FIG. 27A shows the cytokine production of IFNγ and TNFα; FIG. 27B shows the cytokine production of IL-2.

FIG. 30A shows the mice administered untransduced cells; FIG. 30B shows the mice administered the T cells expressing RNA CAR123-2; FIG. 30C shows the mice administered lentivirally transduced T cells expressing CAR123-2; FIG. 30D shows the mice administered T cells expressing RNA tool CAR123.

FIGS. 31A, 31B, 31C, 31D, 31E, and 31F show CD123 is highly expressed in CD19-neg B-cell acute lymphoblastic leukemia relapses occurring after CART19 treatment. FIG. 31A shows expression of CD123 compared to CD19 in 42 relapsing/refractory ALL samples. FIG. 31B shows CD123 and CD19 co-expression in B-ALL blasts. Gated on blasts (SSC low, singlet, live, CD45dim). FIG. 31C shows the gating strategy for the leukemia stem cell (LSC). CD123 is highly expressed in this subset. FIG. 31D shows CD123 and CD19 co-expression and results from FISH analysis. FIGS. 31E and 31F show the comparison of CD19 and CD123 expression at baseline or after relapse.

FIG. 32A shows CD19 and CD123 expression; FIG. 32B shows a CD107a degranulation assay; FIG. 32C shows the capability for targeted cell killing; FIGS. 32D and E shows proliferation capacity; FIG. 32F shows cytokine production for the indicated cytokines.

FIG. 33A shows the tumor burden represented by bioluminescent imaging; FIG. 33B shows the overall survival curve of mice receiving CART therapy; and FIG. 33C shows the expansion of CART123 cells in the peripheral blood.

FIG. 34A shows the experimental schema; FIG. 34B shows disease progression as represented by bioluminescent imaging in baseline and relapse disease with respect to CD19 expression (top graph) and in response to treatment with CART19 therapy (bottom graph); FIG. 34C shows bioluminescent images of mice administered untransduced T cells or CART19 cells; FIG. 34D shows the experimental schema for treating with CART19 or CART123; FIG. 34E shows the disease progression; and FIG. 34F shows the overall survival of the treated mice.

FIG. 35A shows the experimental schema; FIG. 35B shows representative multiphoton XY plane images of CART19 cells and CART123 cells interacting with ALL tumor engineered to express either CD19 and CD123 or CD123 alone (motile cells are indicated in dashed circles, non-motile cells are indicated with the arrows); and FIG. 35C is a graphic representation of the microscopy images.

FIG. 36A shows the experimental schema; FIG. 36B shows the disease progression (tumor burden as represented by BLI) of mice treated with untransduced T cells (top graph), CART19 (middle graph), or the combination of CART19 and CART123 (bottom graph); and FIG. 36C shows the overall survival from this experiment.

FIGS. 38A and 38B show characterization of ALL blasts. FIG. 38A shows expression of various markers CD19, CD123, CD10, CD34, and CD20; and FIG. 38B shows the gating strategy for sorting CD19−CD123+ cells.

FIG. 39A shows the expression of CD19 and CD123 on the NALM6 cells; FIG. 39B shows the tumor burden (as represented by BLI) in response to CART19 or CART123 therapy; FIG. 39C shows the overall survival of mice administered CART19 or CART123; and FIG. 39D shows the overall survival of mice administered varying doses of CART123.

FIG. 40A shows the expression of CD123 in CD19 negative relapse disease; and FIG. 40B shows the degranulation assay of CART19 or CART123 cells when cultured with baseline or relapse cells in vitro.

FIG. 50A compares CART123 with the combination of CART123 and PD1 inhibitor; FIG. 50B compares CART123 with the combination of CART123 and PD1 inhibitor and TIM3 inhibitor; FIG. 50C compares CART123 with the combination of CART123 and TIM3 inhibitor, and FIG. 50D shows a representative plot for the data presented in FIGS. 50A-C.

FIGS. 51A, 51B, 51C, 51D, and 51E show the various configurations on a single vector, e.g., where the U6 regulated shRNA is upstream or downstream of the EF1 alpha regulated CAR encoding elements. In the exemplary constructs depicted in FIGS. 51A and 51B, the transcription occurs through the U6 and EF1 alpha promoters in the same direction. In the exemplary constructs depicted in FIGS. 51C and 51D, the transcription occurs through the U6 and EF1 alpha promoters in different directions. In FIG. 51E, the shRNA (and corresponding U6 promoter) is on a first vector, and the CAR (and corresponding EF1 alpha promoter) is on a second vector.

FIG. 55A shows day 0 PK following the first dose of RAD001. FIG. 55B shows Day 14 PK following the final RAD001 dose. Diamonds denote the 10 mg/kg dose of RAD001; squares denote the 1 mg/kg dose of RAD001; triangles denote the 3 mg/kg dose of RAD001; and x's denote the 10 mg/kg dose of RAD001.

FIG. 56A shows CD4$^+$ CAR T cells; FIG. 56B shows CD8$^+$ CAR T cells. Circles denote PBS; squares denote huCTL019; triangles denote huCTL019 with 3 mg/kg RAD001; inverted triangles denote huCTL019 with 0.3 mg/kg RAD001; diamonds denote huCTL019 with 0.03 mg/kg RAD001; and circles denote huCTL019 with 0.003 mg/kg RAD001.

FIG. 63A is a vector map containing a CAR19 and a CAR123, linked through a P2A sequence. FIG. 63B shows the percentage of cells expressing CAR19, CAR123 (Q3), and both CAR19 (Q1) and CAR123 (Q2).

FIG. 64A is a vector map containing a CAR19 and a CAR123, linked through a P2A sequence. The CAR19 includes a CD3zeta domain while the CAR123 includes a 4-1BB domain. FIG. 64B shows the percentage of cells expressing CAR19, CAR123 (Q3), and both CAR19 (Q1) and CAR123 (Q2).

FIGS. 68A and 68B show CD123 expression on mononuclear cells from the blood of a patient with mast cell leukemia/systemic mastocytosis as detected by staining by isotype antibody (FIG. 68A) as control or CD123 antibody (FIG. 68B).

FIGS. 69A and 69B show a CD107 degranulation assay where CART123 cells were cultured alone with PMA and ionomycin (FIG. 69A) or with mononuclear cells from the blood of a patient with mast cell leukemia/systemic mastocytosis (FIG. 69B).

FIGS. 72A, 72B, and 72C show the results of T cell ablation using anti-CD52 antibody alemtuzumab after treatment with lentivirally transduced CART123 cells in a MOLM14 xenograft model. CART123 cells or untransduced (UTD) cells were administered to mice at week 1. Alemtuzumab was administered at week 2, week 3, or week 4 to mice that received CART123 cells, and tumor burden was assessed for 24 weeks. A "MOLM14" rechallenge was introduced at 12 weeks. FIG. 72A shows tumor burden as detected by bioluminonescent imaging (photons/sec); FIG. 72B shows the percent of CART cells detected in peripheral blood; and FIG. 72C shows the overall survival.

FIG. 73A shows tumor burden as detected by bioluminonescent imaging (photons/sec); FIG. 73B shows the percent of CART cells detected in peripheral blood.

DETAILED DESCRIPTION

Definitions

Figure 1:
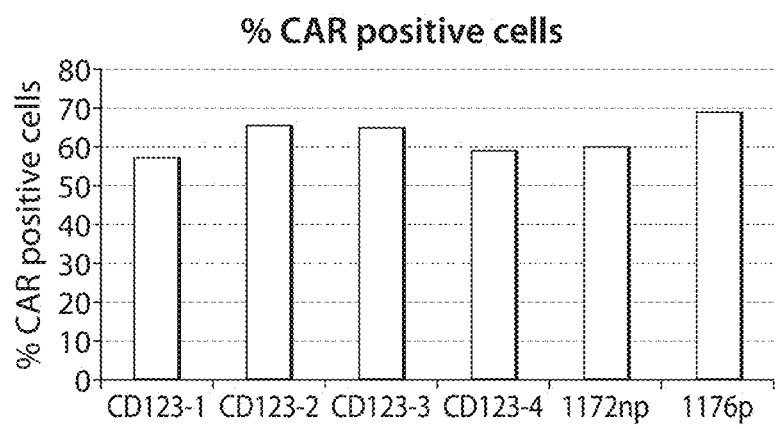
FIG. 1 shows a graphical representation of CAR expression in JNL cells transduced with anti-CD123 CAR constructs as evaluated by FACS and reported as the percent of cells showing signal above the level of signal in untransduced (CAR negative) cells using Protein L as a detection reagent.

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "Chimeric Antigen Receptor" or alternatively a "CAR" refers to a recombinant polypeptide construct comprising at least an extracellular antigen binding domain, a transmembrane domain and a cytoplasmic signaling domain (also referred to herein as "an intracellular signaling domain") comprising a functional signaling domain derived from a stimulatory molecule as defined below. In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains, e.g., as provided in an RCAR as described herein.

In one aspect, the stimulatory molecule of the CAR is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from 4-1BB (i.e., CD137), CD27, ICOS, and/or CD28. In one aspect, the CAR comprises a chimeric fusion protein comprising an extracellular antigen recognition domain, a transmembrane domain and an intracellular signaling domain comprising a functional signaling domain derived from a stimulatory molecule. In one aspect, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one aspect, the CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In one aspect, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen recognition domain, wherein the leader sequence is optionally cleaved from the antigen recognition domain (e.g., aa scFv) during cellular processing and localization of the CAR to the cellular membrane.

A CAR that comprises an antigen binding domain (e.g., a scFv, a single domain antibody, or TCR (e.g., a TCR alpha binding domain or TCR beta binding domain)) that specifically binds a specific tumor marker X, wherein X can be a tumor marker as described herein, is also referred to as XCAR. For example, a CAR that comprises an antigen binding domain that specifically binds CD123 is referred to as CD123 CAR. The CAR can be expressed in any cell, e.g., an immune effector cell as described herein (e.g., a T cell or an NK cell).

The term "signaling domain" refers to the functional portion of a protein which acts by transmitting information within the cell to regulate cellular activity via defined signaling pathways by generating second messengers or functioning as effectors by responding to such messengers.

As used herein, the terms "alpha subunit of the IL-3 receptor," "IL3Rα," "CD123," "IL3Rα chain" and "IL3Rα subunit" refer interchangeably to an antigenic determinant known to be detectable on leukemia precursor cells. The human and murine amino acid and nucleic acid sequences can be found in a public database, such as GenBank, UniProt and Swiss-Prot. For example, the amino acid sequence of human IL3Rα can be found at Accession No. NP 002174 and the nucleotide sequence encoding of the human IL3Rα can be found at Accession No. NM 005191. In one aspect the antigen-binding portion of the CAR recognizes and binds an epitope within the extracellular domain of the CD123 protein. In one aspect, the CD123 protein is expressed on a cancer cell. As used herein, "CD123" includes proteins comprising mutations, e.g., point mutations, fragments, insertions, deletions and splice variants of full length wild-type CD123.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an intact antibody, or recombinant variants thereof, and refers to the antigen binding domain, e.g., an antigenic determining variable region of an intact antibody, that is sufficient to confer recognition and specific binding of the antibody fragment to a target, such as an antigen. Examples of antibody fragments include, but are not limited to, Fab, Fab', F(ab')$_2$, and Fv fragments, scFv antibody fragments, linear antibodies, single domain antibodies such as sdAb (either VL or VH), camelid VHH domains, and multi-specific antibodies formed from antibody fragments such as a bivalent fragment comprising two Fab fragments linked by a disulfide brudge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "complementarity determining region" or "CDR," as used herein, refers to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR composition of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized or human antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

As used herein, the term "binding domain" or "antibody molecule" (also referred to herein as "anti-target (e.g., CD123) binding domain") refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-tumor effect" refers to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the peptides, polynucleotides, cells and antibodies of the invention in prevention of the occurrence of tumor in the first place.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place.

The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species. The term "apheresis" as used herein refers to the art-recognized extracorporeal process by which the blood of a donor or patient is removed from the donor or patient and passed through an apparatus that separates out selected particular constituent(s) and returns the remainder to the circulation of the donor or patient, e.g., by retransfusion. Thus, in the context of "an apheresis sample" refers to a sample obtained using apheresis.

The term "combination" refers to either a fixed combination in one dosage unit form, or a combined administration where a compound of the present invention and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time.

The term "pharmaceutical combination" as used herein means a product that results from the mixing or combining of more than one active ingredient and includes both fixed and non-fixed combinations of the active ingredients. The term "fixed combination" means that the active ingredients, e.g. a compound of the present invention and a combination partner, are both administered to a patient simultaneously in the form of a single entity or dosage. The term "non-fixed combination" means that the active ingredients, e.g. a compound of the present invention and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more active ingredients.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of CD123" as used herein includes but is not limited to, a disease associated with expression of CD123 or condition associated with a cell which expresses CD123 (e.g., wild-type or mutant CD123) including, e.g., a proliferative disease such as a cancer or malignancy; a precancerous condition such as a myelodysplasia, a myelodysplastic syndrome or a preleukemia; or a non-cancer related indication associated with a cell which expresses CD123 (e.g., wild-type or mutant CD123). In one aspect, a cancer associated with expression of CD123 (e.g., wild-type or mutant CD123) is a hematological cancer. In one aspect, the disease includes AML, ALL, hairy cell leukemia, Prolymphocytic leukemia, Chronic myeloid leukemia (CML), Hodgkin lymphoma, Blastic plasmacytoid dendritic cell neoplasm, lymphoblastic B-cell leukemia (B-cell acute lymphoid leukemia, BALL), acute lymphoblastic T-cell leukemia (T-cell acute lymphoid leukemia (TALL); myelodysplastic syndrome; a myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia, and the like. Further disease associated with expression of CD123 expression include, but are not limited to, e.g., atypical and/or non-classical cancers, malignancies, precancerous conditions or proliferative diseases associated with expression of CD123. Non-cancer related indications associated with expression of CD123 may also be included.

In some embodiments, the tumor antigen (e.g., CD123– or CD19–)-expressing cell expresses, or at any time expressed, mRNA encoding the tumor antigen. In an embodiment, the tumor antigen (e.g., CD123– or CD19–)-expressing cell produces the tumor antigen protein (e.g., wild-type or mutant), and the tumor antigen protein may be present at normal levels or reduced levels. In an embodiment, the tumor antigen (e.g., CD123– or CD19–)-expressing cell produced detectable levels of a tumor antigen protein at one point, and subsequently produced substantially no detectable tumor antigen protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as downregulation of TGF-β, and/or reorganization of cytoskeletal structures, and the like.

The term "stimulatory molecule," refers to a molecule expressed by a T cell that provides the primary cytoplasmic signaling sequence(s) that regulate primary activation of the TCR complex in a stimulatory way for at least some aspect of the T cell signaling pathway. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10 and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:9, or the equivalent residues from a non-human species, e.g., mouse, rodent, monkey, ape and the like. In a specific CAR of the invention, the primary signaling sequence of CD3-zeta is the sequence as provided in SEQ ID NO:10, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain can generate a signal that promotes an immune effector function of the CAR containing cell, e.g., a CART cell or CAR-expressing NK cell. Examples of immune effector function, e.g., in a CART cell or CAR-expressing NK cell, include cytolytic activity and helper activity, including the secretion of cytokines. In embodiments, the intracellular signal domain transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CAR-expressing immune effector cell, e.g., CART cell or CAR-expressing NK cell, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CDS, CD22, CD79a, CD79b, CD278 ("ICOS"), FcεRI, CD66d, DAP10, and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:9. In one aspect, the "zeta stimulatory domain" or a "CD3-zeta stimulatory domain" is the sequence provided as SEQ ID NO:10.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to the intracellular portion of a costimulatory molecule. The intracellular signaling domain can comprise the entire intracellular portion, or the entire native intracellular signaling domain, of the molecule from which it is derived, or a functional fragment thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank accno. AAA62478.2, or the equivalent residues from a non-human species, e.g., mouse, rodent, monkey, ape and the like. In one aspect, the "4-1BB costimulatory domain" is the sequence provided as SEQ ID NO:7 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "vector" as used herein refers to any vehicle that can be used to deliver and/or express a nucleic acid molecule. It can be a transfer vector or an expression vector as described herein.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid," "polynucleotide," or "nucleic acid molecule" refers to deoxyribonucleic acid (DNA) or ribonucleic acid (RNA), or a combination of a DNA or RNA thereof, and polymers thereof in either single- or double-stranded form. The term "nucleic acid" includes a gene, cDNA or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The term "cancer associated antigen" or "tumor antigen" interchangeably refers to a molecule (typically a protein, carbohydrate or lipid) that is expressed on the surface of a cancer cell, either entirely or as a fragment (e.g., MHC/peptide), and which is useful for the preferential targeting of a pharmacological agent to the cancer cell. In some embodiments, a tumor antigen is a marker expressed by both normal cells and cancer cells, e.g., a lineage marker, e.g., CD19 or CD123 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n (SEQ ID NO: 38), where n is a positive integer equal to or greater than 1. For example, n=1, n=2, n=3. n=4, n=5 and n=6, n=7, n=8, n=9 and n=10 In one embodiment, the flexible polypeptide linkers include, but are not limited to, (Gly4 Ser)4 (SEQ ID NO:27) or (Gly4 Ser)3 (SEQ ID NO:28). In another embodiment, the linkers include multiple repeats of (Gly2Ser), (GlySer) or (Gly3Ser) (SEQ ID NO:29). Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 30), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, non-Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

"Regulatable chimeric antigen receptor (RCAR)," as used herein, refers to a set of polypeptides, typically two in the simplest embodiments, which when in an immune effector cell, provides the cell with specificity for a target cell, typically a cancer cell, and with regulatable intracellular signal generation. In some embodiments, an RCAR comprises at least an extracellular antigen binding domain, a transmembrane and a cytoplasmic signaling domain (also referred to herein as "an intracellular signaling domain") comprising a functional signaling domain derived from a stimulatory molecule and/or costimulatory molecule as defined herein in the context of a CAR molecule. In some embodiments, the set of polypeptides in the RCAR are not contiguous with each other, e.g., are in different polypeptide chains. In some embodiments, the RCAR includes a dimerization switch that, upon the presence of a dimerization molecule, can couple the polypeptides to one another, e.g., can couple an antigen binding domain to an intracellular signaling domain. In some embodiments, the RCAR is expressed in a cell (e.g., an immune effector cell) as described herein, e.g., an RCAR-expressing cell (also referred to herein as "RCARX cell"). In an embodiment the RCARX cell is a T cell, and is referred to as a RCART cell.

In an embodiment the RCARX cell is an NK cell, and is referred to as a RCARN cell. The RCAR can provide the RCAR-expressing cell with specificity for a target cell, typically a cancer cell, and with regulatable intracellular signal generation or proliferation, which can optimize an immune effector property of the RCAR-expressing cell. In embodiments, an RCAR cell relies at least in part, on an antigen binding domain to provide specificity to a target cell that comprises the antigen bound by the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative immune effector cells, e.g., T cells or NK cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative immune effector cells, e.g., T cells or NK cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive immune effector cells, e.g., T cells or NK cells, and/or an increase in the number of PD-1 negative immune effector cells, e.g., T cells or NK cells, or an increase in the ratio of PD-1 negative T cells/PD-1 positive immune effector cells, e.g., T cells or NK cells.

In an embodiment, the low, immune enhancing, dose of mTOR inhibitor results in an increase in the number of naive immune effector cells, e.g., T cells or NK cells. In an embodiment, the low, immune enhancing, dose of mTOR inhibitor results in one or more of the following:

an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$, increased $CD127^{high}$, increased $CD27^+$, decreased KLRG1, and increased BCL2;

wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" or "relapse" as used herein refers to the return or reappearance of a disease (e.g., cancer) or the signs and symptoms of a disease such as cancer after a period of improvement or responsiveness, e.g., after prior treatment of a therapy, e.g., cancer therapy. The initial period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%. For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

In some embodiments, a therapy that includes a CD19 inhibitor, e.g., a CD19 CAR therapy, may relapse or be refractory to treatment. The relapse or resistance can be caused by CD19 loss (e.g., an antigen loss mutation) or other CD19 alteration that reduces the level of CD19 (e.g., caused by clonal selection of CD19-negative clones). A cancer that harbors such CD19 loss or alteration is referred to herein as a "CD19-negative cancer" or a "CD19-negative relapsed cancer"). It shall be understood that a CD19-negative cancer need not have 100% loss of CD19, but a sufficient reduction to reduce the effectiveness of a CD19 therapy such that the cancer relapses or becomes refractory. In some embodiments, a CD19-negative cancer results from a CD19 CAR therapy.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Description

Provided herein are compositions of matter and methods of use for the treatment or prevention of a disease such as cancer using CD123 chimeric antigen receptors (CAR).

In one aspect, the invention provides a number of chimeric antigen receptors (CAR) comprising an antibody or antibody fragment engineered for specific binding to a CD123 protein or fragments thereof. In one aspect, the invention provides a cell (e.g., an immune effector cell, e.g., a T cell or a NK cell) engineered to express a CAR, wherein the CAR-expressing cell (e.g., "CART" or CAR-expressing NK cell) exhibits an antitumor property. In one aspect a cell is transformed with the CAR and the at least part of the CAR is expressed on the cell surface. In some embodiments, the cell (e.g., immune effector cell, e.g., T cell or NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., immune effector cell, e.g., T cell or NK cell) is transfected with a nucleic acid, e.g., mRNA, cDNA, DNA, encoding a CAR. In some such embodiments, the cell may transiently express the CAR.

In one aspect, the CD123 binding domain, e.g., the human or humanized CD123 binding domain, of the CAR is a scFv antibody fragment. In one aspect, such antibody fragments are functional in that they retain the equivalent binding affinity, e.g., they bind the same antigen with comparable efficacy, as the IgG antibody having the same heavy and light chain variable regions. In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan.

In some aspects, the antibodies of the invention are incorporated into a chimeric antigen receptor (CAR). In one aspect, the CAR comprises the polypeptide sequence provided herein as SEQ ID NOS: 98-101, and 125-156.

In one aspect, the CD123 binding domain, e.g., humanized or human CD123 binding domain, portion of a CAR of the invention is encoded by a transgene whose sequence has been codon optimized for expression in a mammalian cell. In one aspect, entire CAR construct of the invention is encoded by a transgene whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

In one aspect, the antigen binding domain of the CAR comprises a human CD123 antibody or antibody fragment. In one aspect, the antigen binding domain of the CAR comprises a humanized CD123 antibody or antibody fragment. In one aspect, the antigen binding domain of the CAR comprises human CD123 antibody fragment comprising an scFv. In one aspect, the antigen binding domain of the CAR is a human CD123 scFv. In one aspect, the antigen binding domain of the CAR comprises a humanized CD123 antibody fragment comprising an scFv. In one aspect, the antigen binding domain of the CAR is a humanized CD123 scFv.

In one aspect, the CAR123 binding domain comprises the scFv portion provided in SEQ ID NO:157-160 and 184-215. In one aspect the scFv portion is human. In one aspect, the human CAR123 binding domain comprises the scFv portion provided in SEQ ID NO:157-160. In one aspect, the human CD123 binding domain comprises the scFv portion provided in SEQ ID NO: 157. In one aspect, the human CD123 binding domain comprises the scFv portion provided in SEQ ID NO: 158. In one aspect, the human CD123 binding domain comprises the scFv portion provided in SEQ ID NO: 159. In one aspect, the human CD123 binding domain comprises the scFv portion provided in SEQ ID NO: 160. In one aspect, the human CD123 binding domain comprises the scFv portion provided in SEQ ID NO: 478. In one aspect, the human CD123 binding domain comprises the scFv portion provided in SEQ ID NO: 480. In one aspect, the human CD123 binding domain comprises the scFv portion provided in SEQ ID NO: 483. In one aspect, the human CD123 binding domain comprises the scFv portion provided in SEQ ID NO: 485.

In one aspect the scFv portion is humanized. In one aspect, the humanized CAR123 binding domain comprises the scFv portion provided in SEQ ID NO:184-215. In one aspect, the humanized CD123 binding domain comprises the scFv portion provided in SEQ ID NO: 184. In one aspect, the humanized CD123 binding domain comprises the scFv portion provided in SEQ ID NO: 185. In one aspect, the humanized CD123 binding domain comprises the scFv portion provided in SEQ ID NO: 186. In one aspect, the humanized CD123 binding domain comprises the scFv portion provided in SEQ ID NO: 187. In one aspect, the humanized CD123 binding domain comprises the scFv portion provided in SEQ ID NO: 188. In one aspect, the humanized CD123 binding domain comprises the scFv portion provided in SEQ ID NO: 189. In one aspect, the humanized CD123 binding domain comprises the scFv portion provided in SEQ ID NO: 190. In one aspect, the humanized CD123 binding domain comprises the scFv portion provided in SEQ ID NO: 191. In one aspect, the humanized CD123 binding domain comprises the scFv portion provided in SEQ ID NO: 192. In one aspect, the humanized CD123 binding domain comprises the scFv portion provided in SEQ ID NO: 193. In one aspect, the humanized CD123 binding domain comprises the scFv portion provided in SEQ ID NO: 194. In one aspect, the humanized CD123 binding domain comprises the scFv portion provided in SEQ ID NO: 195. In one aspect, the humanized CD123 binding domain comprises the scFv portion provided in SEQ ID NO: 196. In one aspect, the humanized CD123 binding domain comprises the scFv portion provided in SEQ ID NO: 197. In one aspect, the humanized CD123 binding domain comprises the scFv portion provided in SEQ ID NO: 198. In one aspect, the humanized CD123 binding domain comprises the scFv portion provided in SEQ ID NO: 199. In one aspect, the humanized CD123 binding domain comprises the scFv portion provided in SEQ ID NO: 200. In one aspect, the humanized CD123 binding domain comprises the scFv portion provided in SEQ ID NO: 201. In one aspect, the humanized CD123 binding domain comprises the scFv portion provided in SEQ ID NO: 202. In one aspect, the humanized CD123 binding domain comprises the scFv portion provided in SEQ ID NO: 203. In one aspect, the humanized CD123 binding domain comprises the scFv portion provided in SEQ ID NO: 204. In one aspect, the humanized CD123 binding domain comprises the scFv portion provided in SEQ ID NO: 205. In one aspect, the humanized CD123 binding domain comprises the scFv portion provided in SEQ ID NO: 206. In one aspect, the humanized CD123 binding domain comprises the scFv portion provided in SEQ ID NO: 207. In one aspect, the humanized CD123 binding domain comprises the scFv portion provided in SEQ ID NO: 208. In one aspect, the humanized CD123 binding domain comprises the scFv portion provided in SEQ ID NO: 209. In one aspect, the humanized CD123 binding domain comprises the scFv portion provided in SEQ ID NO: 210. In one aspect, the humanized CD123 binding domain comprises the scFv portion provided in SEQ ID NO: 211. In one aspect, the humanized CD123 binding domain comprises the scFv portion provided in SEQ ID NO: 212. In one aspect, the humanized CD123 binding domain comprises the scFv portion provided in SEQ ID NO: 213. In one aspect, the humanized CD123 binding domain comprises the scFv portion provided in SEQ ID NO: 214. In one aspect, the humanized CD123 binding domain comprises the scFv portion provided in SEQ ID NO: 215. In one aspect, the humanized CD123 binding domain comprises the scFv portion provided in SEQ ID NOs: 556-587.

Furthermore, the present invention provides CD123 CAR compositions and their use in medicaments or methods for treating, among other diseases, cancer or any malignancy or autoimmune diseases involving cells or tissues which express CD123.

In one aspect, the CAR of the invention can be used to eradicate CD123-expressing normal cells, thereby applicable for use as a cellular conditioning therapy prior to cell transplantation. In one aspect, the CD123-expressing normal cell is a CD123-expressing expressing myeloid progenitor cell and the cell transplantation is a stem cell transplantation.

In one aspect, the invention provides a cell (e.g., an immune effector cell, e.g., a T cell or NK cell) engineered to express a chimeric antigen receptor (e.g., CAR-expressing immune effector cell, e.g., CART or CAR-expressing NK cell) of the present invention, wherein the cell (e.g., "CART") exhibits an antitumor property. Accordingly, the invention provides a CD123-CAR that comprises a CD123 binding domain and is engineered into an immune effector cell, e.g., a T cell or a NK cell, and methods of their use for adoptive therapy.

In one aspect, the CD123-CAR comprises at least one intracellular domain, e.g., described herein, e.g., selected from the group of a CD137 (4-1BB) signaling domain, a CD28 signaling domain, a CD3zeta signal domain, and any combination thereof. In one aspect, the CD123-CAR comprises at least one intracellular signaling domain is from one or more co-stimulatory molecule(s) other than a CD137 (4-1BB) or CD28.

Chimeric Antigen Receptor (CAR)

The present invention encompasses a recombinant DNA construct comprising sequences encoding a CAR, wherein the CAR comprises an antigen binding domain (e.g., antibody, antibody fragment) that binds specifically to CD123 or a fragment thereof, e.g., human CD123, wherein the sequence of the CD123 binding domain (e.g., antibody or antibody fragment) is, e.g., contiguous with and in the same reading frame as a nucleic acid sequence encoding an intracellular signaling domain. The intracellular signaling domain can comprise a costimulatory signaling domain and/or a primary signaling domain, e.g., a zeta chain. The costimulatory signaling domain refers to a portion of the CAR comprising at least a portion of the intracellular domain of a costimulatory molecule.

In specific aspects, a CAR construct of the invention comprises a scFv domain selected from the group consisting of SEQ ID NOS:157-160, 184-215, 478, 480, 483, 485, and 556-587 wherein the scFv may be preceded by an optional leader sequence such as provided in SEQ ID NO: 1, and followed by an optional hinge sequence such as provided in SEQ ID NO:2 or SEQ ID NO:3 or SEQ ID NO:4 or SEQ ID NO:5, a transmembrane region such as provided in SEQ ID NO:6, an intracellular signalling domain that includes SEQ ID NO:7 or SEQ ID NO:8 and a CD3 zeta sequence that includes SEQ ID NO:9 or SEQ ID NO:10, e.g., wherein the domains are contiguous with and in the same reading frame to form a single fusion protein. In some embodiments, the scFv domain is a human scFv domain selected from the group consisting of SEQ ID NOS: 157-160, 478, 480, 483, and 485. In some embodiments, the scFv domain is a humanized scFv domain selected from the group consisting of SEQ ID NOS: 184-215 and 556-587. Also included in the invention is a nucleotide sequence that encodes the polypeptide of each of the scFv fragments selected from the group consisting of SEQ ID NO: 157-160, 184-215, 478, 480, 483, 485, and 556-587. Also included in the invention is a nucleotide sequence that encodes the polypeptide of each of the scFv fragments selected from the group consisting of SEQ ID NO: 157-160, 184-215, 478, 480, 483, 485, and 556-587, and each of the domains of SEQ ID NOS: 1,2, and 6-9, plus the encoded CD123 CAR of the invention.

In one aspect an exemplary CD123CAR constructs comprise an optional leader sequence, an extracellular antigen binding domain, a hinge, a transmembrane domain, and an intracellular stimulatory domain. In one aspect an exemplary CD123CAR construct comprises an optional leader sequence, an extracellular antigen binding domain, a hinge, a transmembrane domain, an intracellular costimulatory domain and an intracellular stimulatory domain.

In some embodiments, full-length CD123 CAR sequences are also provided herein as SEQ ID NOS: 98-101 and 125-156, as shown in Table 2 or 6.

An exemplary leader sequence is provided as SEQ ID NO: 1. An exemplary hinge/spacer sequence is provided as SEQ ID NO:2 or SEQ ID NO:3 or SEQ ID NO:4 or SEQ ID NO:5. An exemplary transmembrane domain sequence is provided as SEQ ID NO:6. An exemplary sequence of the intracellular signaling domain of the 4-1BB protein is provided as SEQ ID NO: 7. An exemplary sequence of the intracellular signaling domain of CD27 is provided as SEQ ID NO:8. An exemplary CD3zeta domain sequence is provided as SEQ ID NO: 9 or SEQ ID NO:10. An exemplary sequence of the intracellular signaling domain of CD28 is provided as SEQ ID NO:43. An exemplary sequence of the intracellular signaling domain of ICOS is provided as SEQ ID NO:45.

In one aspect, the present invention encompasses a recombinant nucleic acid construct comprising a nucleic acid molecule encoding a CAR, wherein the nucleic acid molecule comprises the nucleic acid sequence encoding a CD123 binding domain, e.g., described herein, e.g., that is contiguous with and in the same reading frame as a nucleic acid sequence encoding an intracellular signaling domain. In one aspect, a CD123 binding domain is selected from one or more of SEQ ID NOS: 157-160, 184-215, 478, 480, 483, 485, and 556-587. In some embodiments, the CD123 binding domain is a human CD123 binding domain selected from the group consisting of SEQ ID NOS: 157-160, 478, 480, 483, and 485. In some embodiments, the CD123 binding domain is a humanized CD123 binding domain selected from the group consisting of SEQ ID NOS: 184-215 and 556-587. In one aspect, the CD123 binding domain is SEQ ID NO: 157. In one aspect, the CD123 binding domain is SEQ ID NO: 158. In one aspect, the CD123 binding domain is SEQ ID NO: 159. In one aspect, the CD123 binding domain is SEQ ID NO: 160. In one aspect, the CD123 binding domain is SEQ ID NO: 184. In one aspect, the CD123 binding domain is SEQ ID NO: 185. In one aspect, the CD123 binding domain is SEQ ID NO: 186. In one aspect, the CD123 binding domain is SEQ ID NO: 187. In one aspect, the CD123 binding domain is SEQ ID NO: 188. In one aspect, the CD123 binding domain is SEQ ID NO: 189. In one aspect, the CD123 binding domain is SEQ ID NO: 190. In one aspect, the CD123 binding domain is SEQ ID NO: 191. In one aspect, the CD123 binding domain is SEQ ID NO: 192. In one aspect, the CD123 binding domain is SEQ ID NO: 193. In one aspect, the CD123 binding domain is SEQ ID NO: 194. In one aspect, the CD123 binding domain is SEQ ID NO: 195. In one aspect, the CD123 binding domain is SEQ ID NO: 196. In one aspect, the CD123 binding domain is SEQ ID NO: 197. In one aspect, the CD123 binding domain is SEQ ID NO: 198. In one aspect, the CD123 binding domain is SEQ ID NO: 199. In one aspect, the CD123 binding domain is SEQ ID NO: 200. In one aspect, the CD123 binding domain is SEQ ID NO: 201. In one aspect, the CD123 binding domain is SEQ ID NO: 202. In one aspect, the CD123 binding domain is SEQ ID NO: 203. In one aspect, the CD123 binding domain is SEQ ID NO: 204. In one aspect, the CD123 binding domain is SEQ ID NO: 205. In one aspect, the CD123 binding domain is SEQ ID NO: 206. In one aspect, the CD123 binding domain is SEQ ID NO: 207. In one aspect, the CD123 binding domain is SEQ ID NO: 208. In one aspect, the CD123 binding domain is SEQ ID NO: 209.

In one aspect, the CD123 binding domain is SEQ ID NO: 210. In one aspect, the CD123 binding domain is SEQ ID NO: 211. In one aspect, the CD123 binding domain is SEQ ID NO: 212. In one aspect, the CD123 binding domain is SEQ ID NO: 213. In one aspect, the CD123 binding domain is SEQ ID NO: 213. In one aspect, the CD123 binding domain is SEQ ID NO: 215. In one aspect, the CD123 binding domain is SEQ ID NO: 478. In one aspect, the CD123 binding domain is SEQ ID NO: 480. In one aspect, the CD123 binding domain is SEQ ID NO: 483. In one aspect, the CD123 binding domain is SEQ ID NO: 485.

In one aspect, the present invention encompasses a recombinant nucleic acid construct comprising a nucleic acid molecule encoding a CAR, wherein the nucleic acid molecule comprises a nucleic acid sequence encoding a CD123 binding domain, e.g., wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, ICOS, and the like. In some instances, the CAR can comprise any combination of CD3-zeta, CD28, 4-1BB, ICOS, and the like.

In one aspect, the nucleic acid sequence of a CAR construct of the invention is selected from one or more of SEQ ID NOS:39-42 and 66-97. In one aspect, the nucleic acid sequence of a CAR construct comprises (e.g., consists of) SEQ ID NO:39. In one aspect, the nucleic acid sequence of a CAR construct comprises (e.g., consists of) SEQ ID NO:40. In one aspect, the nucleic acid sequence of a CAR construct comprises (e.g., consists of) SEQ ID NO:41. In one aspect, the nucleic acid sequence of a CAR construct comprises (e.g., consists of) SEQ ID NO:42. In one aspect, the nucleic acid sequence of a CAR construct comprises (e.g., consists of) SEQ ID NO:66. In one aspect, the nucleic acid sequence of a CAR construct comprises (e.g., consists of) SEQ ID NO:67. In one aspect, the nucleic acid sequence of a CAR construct comprises (e.g., consists of) SEQ ID NO:68. In one aspect, the nucleic acid sequence of a CAR construct comprises (e.g., consists of) SEQ ID NO:69. In one aspect, the nucleic acid sequence of a CAR construct comprises (e.g., consists of) SEQ ID NO:70. In one aspect, the nucleic acid sequence of a CAR construct comprises (e.g., consists of) SEQ ID NO:71. In one aspect, the nucleic acid sequence of a CAR construct comprises (e.g., consists of) SEQ ID NO:72. In one aspect, the nucleic acid sequence of a CAR construct comprises (e.g., consists of) SEQ ID NO:73. In one aspect, the nucleic acid sequence of a CAR construct comprises (e.g., consists of) SEQ ID NO:74. In one aspect, the nucleic acid sequence of a CAR construct comprises (e.g., consists of) SEQ ID NO:75. In one aspect, the nucleic acid sequence of a CAR construct comprises (e.g., consists of) SEQ ID NO:76. In one aspect, the nucleic acid sequence of a CAR construct comprises (e.g., consists of) SEQ ID NO:77. In one aspect, the nucleic acid sequence of a CAR construct comprises (e.g., consists of) SEQ ID NO:78. In one aspect, the nucleic acid sequence of a CAR construct comprises (e.g., consists of) SEQ ID NO:79. In one aspect, the nucleic acid sequence of a CAR construct comprises (e.g., consists of) SEQ ID NO:80. In one aspect, the nucleic acid sequence of a CAR construct comprises (e.g., consists of) SEQ ID NO:81. In one aspect, the nucleic acid sequence of a CAR construct comprises (e.g., consists of) SEQ ID NO:82. In one aspect, the nucleic acid sequence of a CAR construct comprises (e.g., consists of) SEQ ID NO:83. In one aspect, the nucleic acid sequence of a CAR construct comprises (e.g., consists of) SEQ ID NO:84. In one aspect, the nucleic acid sequence of a CAR construct comprises (e.g., consists of) SEQ ID NO:85. In one aspect, the nucleic acid sequence of a CAR construct comprises (e.g., consists of) SEQ ID NO:86. In one aspect, the nucleic acid sequence of a CAR construct comprises (e.g., consists of) SEQ ID NO:87. In one aspect, the nucleic acid sequence of a CAR construct comprises (e.g., consists of) SEQ ID NO:88. In one aspect, the nucleic acid sequence of a CAR construct comprises (e.g., consists of) SEQ ID NO:89. In one aspect, the nucleic acid sequence of a CAR construct comprises (e.g., consists of) SEQ ID NO:90. In one aspect, the nucleic acid sequence of a CAR construct comprises (e.g., consists of) SEQ ID NO:91. In one aspect, the nucleic acid sequence of a CAR construct comprises (e.g., consists of) SEQ ID NO:92. In one aspect, the nucleic acid sequence of a CAR construct comprises (e.g., consists of) SEQ ID NO:93. In one aspect, the nucleic acid sequence of a CAR construct comprises (e.g., consists of) SEQ ID NO:94. In one aspect, the nucleic acid sequence of a CAR construct comprises (e.g., consists of) SEQ ID NO:95. In one aspect, the nucleic acid sequence of a CAR construct comprises (e.g., consists of) SEQ ID NO:96. In one aspect, the nucleic acid sequence of a CAR construct comprises (e.g., consists of) SEQ ID NO:97. The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the nucleic acid of interest can be produced synthetically, rather than cloned.

The present invention includes retroviral and lentiviral vector constructs expressing a CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:35). RNA so produced can efficiently transfect different kinds of cells. In one embodiment, the template includes sequences for the CAR. In an embodiment, an RNA CAR vector is transduced into a T cell by electroporation.

Antigen Binding Domain

In one aspect, the CAR of the invention comprises a target-specific binding element otherwise referred to as an antigen binding domain. The choice of moiety depends upon the type and number of ligands that define the surface of a target cell. For example, the antigen binding domain may be chosen to recognize a ligand that acts as a cell surface marker on target cells associated with a particular disease state.

In one aspect, the CAR-mediated T-cell response can be directed to an antigen of interest by way of engineering an antigen binding domain that specifically binds a desired antigen into the CAR.

In one aspect, the portion of the CAR comprising the antigen binding domain comprises an antigen binding domain that targets CD123 or a fragment thereof. In one aspect, the antigen binding domain targets human CD123 or a fragment thereof.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment. Thus, in one aspect, the antigen binding domain comprises a human antibody or an antibody fragment. In one embodiment, the human CD123 binding domain comprises one or more (e.g., all three) light chain complementary determining region 1 (LC CDR1), light chain complementary determining region 2 (LC CDR2), and light chain complementary determining region 3 (LC CDR3) of a human CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a human CD123 binding domain described herein, e.g., a human CD123 binding domain comprising one or more, e.g., all three, LC CDRs and one or more, e.g., all three, HC CDRs. In one embodiment, the human CD123 binding domain comprises one or more (e.g., all three) heavy chain complementary determining region 1 (HC CDR1), heavy chain complementary determining region 2 (HC CDR2), and heavy chain complementary determining region 3 (HC CDR3) of a human CD123 binding domain described herein, e.g., the human CD123 binding domain has two variable heavy chain regions, each comprising a HC CDR1, a HC CDR2 and a HC CDR3 described herein. In one embodiment, the human CD123 binding domain comprises a human light chain variable region described herein (e.g., in Table 2 or 9) and/or a human heavy chain variable region described herein (e.g., in Table 2 or 9). In one embodiment, the human CD123 binding domain comprises a human heavy chain variable region described herein (e.g., in Table 2 or 9), e.g., at least two human heavy chain variable regions described herein (e.g., in Table 2 or 9). In one embodiment, the CD123 binding domain is a scFv comprising a light chain and a heavy chain of an amino acid sequence of Table 2 or 9. In an embodiment, the CD123 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 2 or 9, or a sequence with 95-99% identity with an amino acid sequence of Table 2; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 2 or 9, or a sequence with 95-99% identity to an amino acid sequence of Table 2 or 9. In one embodiment, the human CD123 binding domain comprises a sequence selected from a group consisting of SEQ ID NO:157-160, 478, 480, 483, and 485, or a sequence with 95-99% identity thereof. In one embodiment, the human CD123 binding domain is a scFv, and a light chain variable region comprising an amino acid sequence described herein, e.g., in Table 2 or 9, is attached to a heavy chain variable region comprising an amino acid sequence described herein, e.g., in Table 2, via a linker, e.g., a linker described herein. In one embodiment, the human CD123 binding domain includes a (Gly$_4$-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

In some aspects, a non-human antibody is humanized, where specific sequences or regions of the antibody are modified to increase similarity to an antibody naturally produced in a human or fragment thereof. Thus, in one aspect, the antigen binding domain comprises a humanized antibody or an antibody fragment. In one embodiment, the humanized CD123 binding domain comprises one or more (e.g., all three) light chain complementary determining region 1 (LC CDR1), light chain complementary determining region 2 (LC CDR2), and light chain complementary determining region 3 (LC CDR3) of a humanized CD123 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized CD123 binding domain described herein, e.g., a humanized CD123 binding domain comprising one or more, e.g., all three, LC CDRs and one or more, e.g., all three, HC CDRs. In one embodiment, the humanized CD123 binding domain comprises one or more (e.g., all three) heavy chain complementary determining region 1 (HC CDR1), heavy chain complementary determining region 2 (HC CDR2), and heavy chain complementary determining region 3 (HC CDR3) of a humanized CD123 binding domain described herein, e.g., the humanized CD123 binding domain has two variable heavy chain regions, each comprising a HC CDR1, a HC CDR2 and a HC CDR3 described herein. In one embodiment, the humanized CD123 binding domain comprises a humanized light chain variable region described herein (e.g., in Table 6) and/or a humanized heavy chain variable region described herein (e.g., in Table 6). In one embodiment, the humanized CD123 binding domain comprises a humanized heavy chain variable region described herein (e.g., in Table 6), e.g., at least two humanized heavy chain variable regions described herein (e.g., in Table 6). In one embodiment, the CD123 binding domain is a scFv comprising a light chain and a heavy chain of an amino acid sequence of Table 6. In an embodiment, the CD123 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 4, or a sequence with 95-99% identity with an amino acid sequence of Table 6; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 6, or a sequence with 95-99% identity to an amino acid sequence of Table 6. In one embodiment, the humanized CD123 binding domain comprises a sequence selected from a group consisting of SEQ ID NO:184-215 and 302-333, or a sequence with 95-99% identity thereof. In one embodiment, the humanized CD123 binding domain is a scFv, and a light chain variable region comprising an amino acid sequence described herein, e.g., in Table 6, is attached to a heavy chain variable region comprising an amino acid sequence described herein, e.g., in Table 6, via a linker, e.g., a linker described herein. In one embodiment, the humanized CD123 binding domain includes a (Gly4-Ser)n linker, wherein n is 1, 2, 3, 4, 5, or 6, preferably 3 or 4 (SEQ ID NO:26). The light chain variable region and heavy chain variable region of a scFv can be, e.g., in any of the following orientations: light chain variable region-linker-heavy chain variable region or heavy chain variable region-linker-light chain variable region.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source which is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530, 101; 5,585,089; 6,548,640, the contents of which are incorporated herein by reference herein in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In some embodiments, the framework region, e.g., all four framework regions, of the heavy chain variable region are derived from a VH4_4-59 germline sequence. In one embodiment, the framework region can comprise, one, two, three, four or five modifications, e.g., substitutions, e.g., from the amino acid at the corresponding murine sequence. In one embodiment, the framework region, e.g., all four framework regions of the light chain variable region are derived from a VK3_1.25 germline sequence. In one embodiment, the framework region can comprise, one, two, three, four or five modifications, e.g., substitutions, e.g., from the amino acid at the corresponding murine sequence.

In some aspects, the portion of a CAR composition of the invention that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

A humanized antibody or antibody fragment may retain a similar antigenic specificity as the original antibody, e.g., in the present invention, the ability to bind human CD123 or a fragment thereof. In some embodiments, a humanized antibody or antibody fragment may have improved affinity and/or specificity of binding to human CD123 or a fragment thereof.

In one aspect, the antigen binding domain portion comprises one or more sequence selected from SEQ ID NOS: 157-160, 184-215, 478, 480, 483, 485, and 556-587. In one aspect, the CD123 CAR that includes a human CD123 binding domain is selected from one or more sequence selected from SEQ ID NOS:157-160, 478, 480, 483, and 485. In one aspect, the CD123 CAR that includes a humanized CD123 binding domain is selected from one or more sequence selected from SEQ ID NOS:184-215 and 556-587.

In one aspect, the CD123 binding domain is characterized by particular functional features or properties of an antibody or antibody fragment. For example, in one aspect, the portion of a CAR composition of the invention that comprises an antigen binding domain specifically binds human CD123 or a fragment thereof. In one aspect, the invention relates to an antigen binding domain comprising an antibody or antibody fragment, wherein the antibody binding domain specifically binds to a CD123 protein or fragment thereof, wherein the antibody or antibody fragment comprises a variable light chain and/or a variable heavy chain that includes an amino acid sequence of SEQ ID NO: 157-160, 184-215, 478, 480, 483, 485, and 556-587. In one aspect, the antigen binding domain comprises an amino acid sequence of an scFv selected from SEQ ID NO: 157-160, 184-215, 478, 480, 483, 485, and 556-587. In certain aspects, the scFv is contiguous with and in the same reading frame as a leader sequence. In one aspect the leader sequence is the polypeptide sequence provided as SEQ ID NO:1.

In one aspect, the CD123 binding domain is a fragment, e.g., a single chain variable fragment (scFv). In one aspect, the CD123 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD123 protein or a fragment thereof with wild-type or enhanced affinity.

In some instances, a human scFv can be derived from a display library. A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a Fab. In one exemplary embodiment, a display library can be used to identify a human CD123 binding domain. In a selection, the polypeptide component of each member of the library is probed with CD123, or a fragment thereof, and if the polypeptide component binds to CD123, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component, i.e., the anti-CD123 binding domain, and purification of the polypeptide component for detailed characterization.

A variety of formats can be used for display libraries. Examples include the phaage display. In phage display, the protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) Science 228:1315-1317; WO 92/18619; WO 91/17271; WO 92/20791; WO 92/15679; WO 93/01288; WO 92/01047; WO 92/09690; WO 90/02809; de Haard et al. (1999) J. Biol. Chem 274:18218-30; Hoogenboom et al. (1998) Immunotechnology 4:1-20; Hoogenboom et al. (2000) Immunol Today 2:371-8 and Hoet et al. (2005) Nat Biotechnol. 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other display formats include cell based display (see, e.g., WO 03/029456), protein-nucleic acid fusions (see, e.g., U.S. Pat. No. 6,207,446), ribosome display (See, e.g., Mattheakis et al. (1994) Proc. Natl. Acad. Sci. USA 91:9022 and Hanes et al. (2000) Nat Biotechnol. 18:1287-92; Hanes et al. (2000) Methods Enzymol. 328:404-30; and Schaffitzel et al. (1999) J Immunol Methods. 231(1-2):119-35), and E. coli periplasmic display (2005 Nov. 22; PMID: 16337958).

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly$_4$Ser)n, where n is a positive integer equal to or greater than 1 (SEQ ID NO:25). In one embodiment, the linker can be (Gly$_4$Ser)$_4$ (SEQ ID NO:27) or (Gly$_4$Ser)$_3$(SEQ ID NO:28). Variation in the linker length may retain or enhance activity, giving rise to superior efficacy in activity studies.

Exemplary CD123 CAR Constructs and Antigen Binding Domains

Exemplary CD123 CAR constructs disclose herein comprise an scFv (e.g., a human scFv as disclosed in Tables 2, 6 and 9 herein, optionally preceded with an optional leader sequence (e.g., SEQ ID NO:1 and SEQ ID NO:12 for exemplary leader amino acid and nucleotide sequences, respectively). The sequences of the human scFv fragments (amino acid sequences of SEQ ID NOs:157-160) are provided herein in Table 2. The sequences of human scFv fragments, without the leader sequence, are provided herein in Table 9 (SEQ ID NOs: 479, 481, 482, and 484 for the nucleotide sequences, and SEQ ID NOs: 478, 480, 483, and 485 for the amino acid sequences). The CD123 CAR construct can further include an optional hinge domain, e.g., a CD8 hinge domain (e.g., including the amino acid sequence of SEQ ID NO: 2 or encoded by a nucleic acid sequence of SEQ ID NO:13); a transmembrane domain, e.g., a CD8 transmembrane domain (e.g., including the amino acid sequence of SEQ ID NO: 6 or encoded by the nucleotide sequence of SEQ ID NO: 17); an intracellular domain, e.g., a 4-1BB intracellular domain (e.g., including the amino acid sequence of SEQ ID NO: 7 or encoded by the nucleotide sequence of SEQ ID NO: 18; and a functional signaling domain, e.g., a CD3 zeta domain (e.g., including amino acid sequence of SEQ ID NO: 9 or 10, or encoded by the nucleotide sequence of SEQ ID NO: 20 or 21). In certain embodiments, the domains are contiguous with and in the same reading frame to form a single fusion protein. In other embodiments, the domain are in separate polypeptides, e.g., as in an RCAR molecule as described herein.

In certain embodiments, the full length CD123 CAR molecule includes the amino acid sequence of, or is encoded by the nucleotide sequence of, CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 2, 6, or 9, or a sequence substantially (e.g., 95-99%) identical thereto.

In certain embodiments, the CD123 CAR molecule, or the CD123 antigen binding domain, includes the scFv amino acid sequence of CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 2, 6 or 9; or includes the scFv amino acid sequence of, or is encoded by the nucleotide sequence of, CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, or a sequence substantially identical (e.g., 95-99% identical, or up to 20, 15, 10, 8, 6, 5, 4, 3, 2, or 1 amino acid changes) to any of the aforesaid sequences.

In certain embodiments, the CD123 CAR molecule, or the CD123 antigen binding domain, includes the heavy chain variable region and/or the light chain variable region of CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 2 or 6, or a sequence substantially identical (e.g., 95-99% identical, or up to 20, 15, 10, 8, 6, 5, 4, 3, 2, or 1 amino acid changes) to any of the aforesaid sequences.

In certain embodiments, the CD123 CAR molecule, or the CD123 antigen binding domain, includes one, two or three CDRs from the heavy chain variable region (e.g., HCDR1, HCDR2 and/or HCDR3), provided in Table 3 or 7; and/or one, two or three CDRs from the light chain variable region (e.g., LCDR1, LCDR2 and/or LCDR3) of CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 4 or 8; or a sequence substantially identical (e.g., 95-99% identical, or up to 5, 4, 3, 2, or 1 amino acid changes) to any of the aforesaid sequences.

In certain embodiments, the CD123 CAR molecule, or the CD123 antigen binding domain, includes one, two or three CDRs from the heavy chain variable region (e.g., HCDR1, HCDR2 and/or HCDR3), provided in Table 10; and/or one, two or three CDRs from the light chain variable region (e.g., LCDR1, LCDR2 and/or LCDR3) of CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 11; or a sequence substantially identical (e.g., 95-99% identical, or up to 5, 4, 3, 2, or 1 amino acid changes) to any of the aforesaid sequences.

In certain embodiments, the CD123 molecule, or the CD123 antigen binding domain, includes one, two or three CDRs from the heavy chain variable region (e.g., HCDR1, HCDR2 and/or HCDR3), provided in Table 12; and/or one, two or three CDRs from the light chain variable region (e.g., LCDR1, LCDR2 and/or LCDR3) of CD123-1, CD123-2, CD123-3, CD123-4, hzCD123-1, hzCD123-2, hzCD123-3, hzCD123-4, hzCD123-5, hzCD123-6, hzCD123-7, hzCD123-8, hzCD123-9, hzCD123-10, hzCD123-11, hzCD123-12, hzCD123-13, hzCD123-14, hzCD123-15, hzCD123-16, hzCD123-17, hzCD123-18, hzCD123-19, hzCD123-20, hzCD123-21, hzCD123-22, hzCD123-23, hzCD123-24, hzCD123-25, hzCD123-26, hzCD123-27, hzCD123-28, hzCD123-29, hzCD123-30, hzCD123-31, or hzCD123-32, provided in Table 13; or a sequence substantially identical (e.g., 95-99% identical, or up to 5, 4, 3, 2, or 1 amino acid changes) to any of the aforesaid sequences.

The sequences of CDR sequences of the scFv domains are shown in Tables 3, 7, 10, and 12 for the heavy chain variable domains and in Tables 4, 8, 11, and 13 for the light chain variable domains. "ID" stands for the respective SEQ ID NO for each CDR.

The CDRs provided in Tables 3, 4, 7, and 8 are according to a combination of the Kabat and Chothia numbering scheme.

TABLE 3

Heavy Chain Variable Domain CDRs

| Candidate | HCDR1 | ID | HCDR2 | ID | HCDR3 | ID |
|---|---|---|---|---|---|---|
| CAR123-2 | GYTFTGYYMH | 335 | WINPNSGGTNYAQKFQG | 363 | DMNILATVPFDI | 391 |
| CAR123-3 | GYIFTGYYIH | 337 | WINPNSGGTNYAQKFQG | 364 | DMNILATVPFDI | 392 |
| CAR123-4 | GYTFTGYYMH | 336 | WINPNSGGTNYAQKFQG | 365 | DMNILATVPFDI | 393 |
| CAR123-1 | GYTFTDYYMH | 334 | WINPNSGDTNYAQKFQG | 362 | DMNILATVPFDI | 390 |

TABLE 4

Light Chain Variable Domain CDRs

| Candidate | LCDR1 | ID | LCDR2 | ID | LCDR3 | ID |
|---|---|---|---|---|---|---|
| CAR123-2 | RASQSISSYLN | 419 | AAFSLQS | 447 | QQGDSVPLT | 475 |
| CAR123-3 | RASQSISSYLN | 420 | AASSLQS | 448 | QQGDSVPLT | 476 |
| CAR123-4 | RASQSISSYLN | 421 | AASSLQS | 449 | QQGDSVPLT | 477 |
| CAR123-1 | RASQSISTYLN | 418 | AASSLQS | 446 | QQGDSVPLT | 474 |

TABLE 7

Heavy Chain Variable Domain CDR

| | HCDR1 | ID | HCDR2 | ID | HCDR3 | ID |
|---|---|---|---|---|---|---|
| hzCAR123 | GYTFTSYWMN | 361 | RIDPYDSETHYNQKFKD | 389 | GNWDDY | 417 |

TABLE 8

Light Chain Variable Domain CDR

| | LCDR1 | ID | LCDR2 | ID | LCDR3 | ID |
|---|---|---|---|---|---|---|
| hzCAR123 | RASKSISKDLA | 445 | SGSTLQS | 473 | QQHNKYPYT | 47 |

TABLE 10

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| CAR123-2 | GYYMH | 487 | WINPNSGGTNYAQKFQG | 492 | DMNILATVPFDI | 497 |
| CAR123-3 | GYYIH | 488 | WINPNSGGTNYAQKFQG | 493 | DMNILATVPFDI | 498 |
| CAR123-4 | DYYMH | 489 | WINPNSGDTNYAQKFQG | 494 | DMNILATVPFDI | 499 |
| CAR123-1 | GYYMH | 486 | WINPNSGGTNYAQKFQG | 491 | DMNILATVPFDI | 496 |
| hzCAR123-1 | SYWMN | 490 | RIDPYDSETHYNQKFKD | 495 | GNWDDY | 500 |
| hzCAR123-2 | SYWMN | 490 | RIDPYDSETHYNQKFKD | 495 | GNWDDY | 500 |
| hzCAR123-3 | SYWMN | 490 | RIDPYDSETHYNQKFKD | 495 | GNWDDY | 500 |
| hzCAR123-4 | SYWMN | 490 | RIDPYDSETHYNQKFKD | 495 | GNWDDY | 500 |
| hzCAR123-5 | SYWMN | 490 | RIDPYDSETHYNQKFKD | 495 | GNWDDY | 500 |
| hzCAR123-6 | SYWMN | 490 | RIDPYDSETHYNQKFKD | 495 | GNWDDY | 500 |
| hzCAR123-7 | SYWMN | 490 | RIDPYDSETHYNQKFKD | 495 | GNWDDY | 500 |
| hzCAR123-8 | SYWMN | 490 | RIDPYDSETHYNQKFKD | 495 | GNWDDY | 500 |
| hzCAR123-9 | SYWMN | 490 | RIDPYDSETHYNQKFKD | 495 | GNWDDY | 500 |
| hzCAR123-10 | SYWMN | 490 | RIDPYDSETHYNQKFKD | 495 | GNWDDY | 500 |
| hzCAR123-11 | SYWMN | 490 | RIDPYDSETHYNQKFKD | 495 | GNWDDY | 500 |
| hzCAR123-12 | SYWMN | 490 | RIDPYDSETHYNQKFKD | 495 | GNWDDY | 500 |
| hzCAR123-13 | SYWMN | 490 | RIDPYDSETHYNQKFKD | 495 | GNWDDY | 500 |

TABLE 10-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| hzCAR123-14 | SYWMN | 490 | RIDPYDSETHYNQKFKD | 495 | GNWDDY | 500 |
| hzCAR123-15 | SYWMN | 490 | RIDPYDSETHYNQKFKD | 495 | GNWDDY | 500 |
| hzCAR123-16 | SYWMN | 490 | RIDPYDSETHYNQKFKD | 495 | GNWDDY | 500 |
| hzCAR123-17 | SYWMN | 490 | RIDPYDSETHYNQKFKD | 495 | GNWDDY | 500 |
| hzCAR123-18 | SYWMN | 490 | RIDPYDSETHYNQKFKD | 495 | GNWDDY | 500 |
| hzCAR123-19 | SYWMN | 490 | RIDPYDSETHYNQKFKD | 495 | GNWDDY | 500 |
| hzCAR123-20 | SYWMN | 490 | RIDPYDSETHYNQKFKD | 495 | GNWDDY | 500 |
| hzCAR123-21 | SYWMN | 490 | RIDPYDSETHYNQKFKD | 495 | GNWDDY | 500 |
| hzCAR123-22 | SYWMN | 490 | RIDPYDSETHYNQKFKD | 495 | GNWDDY | 500 |
| hzCAR123-23 | SYWMN | 490 | RIDPYDSETHYNQKFKD | 495 | GNWDDY | 500 |
| hzCAR123-24 | SYWMN | 490 | RIDPYDSETHYNQKFKD | 495 | GNWDDY | 500 |
| hzCAR123-25 | SYWMN | 490 | RIDPYDSETHYNQKFKD | 495 | GNWDDY | 500 |
| hzCAR123-26 | SYWMN | 490 | RIDPYDSETHYNQKFKD | 495 | GNWDDY | 500 |
| hzCAR123-27 | SYWMN | 490 | RIDPYDSETHYNQKFKD | 495 | GNWDDY | 500 |
| hzCAR123-28 | SYWMN | 490 | RIDPYDSETHYNQKFKD | 495 | GNWDDY | 500 |
| hzCAR123-29 | SYWMN | 490 | RIDPYDSETHYNQKFKD | 495 | GNWDDY | 500 |
| hzCAR123-30 | SYWMN | 490 | RIDPYDSETHYNQKFKD | 495 | GNWDDY | 500 |
| hzCAR123-31 | SYWMN | 490 | RIDPYDSETHYNQKFKD | 495 | GNWDDY | 500 |
| hzCAR123-32 | SYWMN | 490 | RIDPYDSETHYNQKFKD | 495 | GNWDDY | 500 |

TABLE 11

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| CAR123-2 | RASQSISSYLN | 502 | AASSLQS | 507 | QQGDSVPLT | 512 |
| CAR123-3 | RASQSISSYLN | 503 | AASSLQS | 508 | QQGDSVPLT | 513 |
| CAR123-4 | RASQSISSYLN | 504 | AASSLQS | 509 | QQGDSVPLT | 514 |
| CAR123-1 | RASQSISTYLN | 501 | AAFSLQS | 506 | QQGDSVPLT | 511 |
| hzCAR123-1 | RASKSISKDLA | 505 | SGSTLQS | 510 | QQHNKYPYT | 515 |
| hzCAR123-2 | RASKSISKDLA | 505 | SGSTLQS | 510 | QQHNKYPYT | 515 |
| hzCAR123-3 | RASKSISKDLA | 505 | SGSTLQS | 510 | QQHNKYPYT | 515 |
| hzCAR123-4 | RASKSISKDLA | 505 | SGSTLQS | 510 | QQHNKYPYT | 515 |
| hzCAR123-5 | RASKSISKDLA | 505 | SGSTLQS | 510 | QQHNKYPYT | 515 |
| hzCAR123-6 | RASKSISKDLA | 505 | SGSTLQS | 510 | QQHNKYPYT | 515 |
| hzCAR123-7 | RASKSISKDLA | 505 | SGSTLQS | 510 | QQHNKYPYT | 515 |
| hzCAR123-8 | RASKSISKDLA | 505 | SGSTLQS | 510 | QQHNKYPYT | 515 |
| hzCAR123-10 | RASKSISKDLA | 505 | SGSTLQS | 510 | QQHNKYPYT | 515 |
| hzCAR123-10 | RASKSISKDLA | 505 | SGSTLQS | 510 | QQHNKYPYT | 515 |
| hzCAR123-11 | RASKSISKDLA | 505 | SGSTLQS | 510 | QQHNKYPYT | 515 |
| hzCAR123-12 | RASKSISKDLA | 505 | SGSTLQS | 510 | QQHNKYPYT | 515 |
| hzCAR123-13 | RASKSISKDLA | 505 | SGSTLQS | 510 | QQHNKYPYT | 515 |
| hzCAR123-14 | RASKSISKDLA | 505 | SGSTLQS | 510 | QQHNKYPYT | 515 |
| hzCAR123-15 | RASKSISKDLA | 505 | SGSTLQS | 510 | QQHNKYPYT | 515 |
| hzCAR123-16 | RASKSISKDLA | 505 | SGSTLQS | 510 | QQHNKYPYT | 515 |
| hzCAR123-17 | RASKSISKDLA | 505 | SGSTLQS | 510 | QQHNKYPYT | 515 |

TABLE 11-continued

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| hzCAR123-18 | RASKSISKDLA | 505 | SGSTLQS | 510 | QQHNKYPYT | 515 |
| hzCAR123-19 | RASKSISKDLA | 505 | SGSTLQS | 510 | QQHNKYPYT | 515 |
| hzCAR123-20 | RASKSISKDLA | 505 | SGSTLQS | 510 | QQHNKYPYT | 515 |
| hzCAR123-21 | RASKSISKDLA | 505 | SGSTLQS | 510 | QQHNKYPYT | 515 |
| hzCAR123-22 | RASKSISKDLA | 505 | SGSTLQS | 510 | QQHNKYPYT | 515 |
| hzCAR123-23 | RASKSISKDLA | 505 | SGSTLQS | 510 | QQHNKYPYT | 515 |
| hzCAR123-24 | RASKSISKDLA | 505 | SGSTLQS | 510 | QQHNKYPYT | 515 |
| hzCAR123-25 | RASKSISKDLA | 505 | SGSTLQS | 510 | QQHNKYPYT | 515 |
| hzCAR123-26 | RASKSISKDLA | 505 | SGSTLQS | 510 | QQHNKYPYT | 515 |
| hzCAR123-27 | RASKSISKDLA | 505 | SGSTLQS | 510 | QQHNKYPYT | 515 |
| hzCAR123-28 | RASKSISKDLA | 505 | SGSTLQS | 510 | QQHNKYPYT | 515 |
| hzCAR123-29 | RASKSISKDLA | 505 | SGSTLQS | 510 | QQHNKYPYT | 515 |
| hzCAR123-30 | RASKSISKDLA | 505 | SGSTLQS | 510 | QQHNKYPYT | 515 |
| hzCAR123-31 | RASKSISKDLA | 505 | SGSTLQS | 510 | QQHNKYPYT | 515 |
| hzCAR123-32 | RASKSISKDLA | 505 | SGSTLQS | 510 | QQHNKYPYT | 515 |

TABLE 12

Heavy Chain Variable Domain CDRs according to the Chothia numbering scheme (Al-Lazikani et al., (1997) JMB 273, 927-948)

| Candidate | HCDR1 | ID | HCDR2 | ID | HCDR3 | ID |
|---|---|---|---|---|---|---|
| CAR123-2 | GYTFTGY | 517 | NPNSGG | 522 | DMNILATVPFDI | 527 |
| CAR123-3 | GYIFTGY | 518 | NPNSGG | 523 | DMNILATVPFDI | 528 |
| CAR123-4 | GYTFTDY | 519 | NPNSGD | 524 | DMNILATVPFDI | 529 |
| CAR123-1 | GYTFTGY | 516 | NPNSGG | 521 | DMNILATVPFDI | 526 |
| hzCAR123-1 | GYTFTSY | 520 | DPYDSE | 525 | GNWDDY | 530 |
| hzCAR123-2 | GYTFTSY | 520 | DPYDSE | 525 | GNWDDY | 530 |
| hzCAR123-3 | GYTFTSY | 520 | DPYDSE | 525 | GNWDDY | 530 |
| hzCAR123-4 | GYTFTSY | 520 | DPYDSE | 525 | GNWDDY | 530 |
| hzCAR123-5 | GYTFTSY | 520 | DPYDSE | 525 | GNWDDY | 530 |
| hzCAR123-6 | GYTFTSY | 520 | DPYDSE | 525 | GNWDDY | 530 |
| hzCAR123-7 | GYTFTSY | 520 | DPYDSE | 525 | GNWDDY | 530 |
| hzCAR123-8 | GYTFTSY | 520 | DPYDSE | 525 | GNWDDY | 530 |
| hzCAR123-9 | GYTFTSY | 520 | DPYDSE | 525 | GNWDDY | 530 |
| hzCAR123-10 | GYTFTSY | 520 | DPYDSE | 525 | GNWDDY | 530 |
| hzCAR123-11 | GYTFTSY | 520 | DPYDSE | 525 | GNWDDY | 530 |
| hzCAR123-12 | GYTFTSY | 520 | DPYDSE | 525 | GNWDDY | 530 |
| hzCAR123-13 | GYTFTSY | 520 | DPYDSE | 525 | GNWDDY | 530 |
| hzCAR123-14 | GYTFTSY | 520 | DPYDSE | 525 | GNWDDY | 530 |
| hzCAR123-15 | GYTFTSY | 520 | DPYDSE | 525 | GNWDDY | 530 |
| hzCAR123-16 | GYTFTSY | 520 | DPYDSE | 525 | GNWDDY | 530 |
| hzCAR123-17 | GYTFTSY | 520 | DPYDSE | 525 | GNWDDY | 530 |
| hzCAR123-18 | GYTFTSY | 520 | DPYDSE | 525 | GNWDDY | 530 |
| hzCAR123-19 | GYTFTSY | 520 | DPYDSE | 525 | GNWDDY | 530 |
| hzCAR123-20 | GYTFTSY | 520 | DPYDSE | 525 | GNWDDY | 530 |
| hzCAR123-21 | GYTFTSY | 520 | DPYDSE | 525 | GNWDDY | 530 |
| hzCAR123-22 | GYTFTSY | 520 | DPYDSE | 525 | GNWDDY | 530 |
| hzCAR123-23 | GYTFTSY | 520 | DPYDSE | 525 | GNWDDY | 530 |
| hzCAR123-24 | GYTFTSY | 520 | DPYDSE | 525 | GNWDDY | 530 |
| hzCAR123-25 | GYTFTSY | 520 | DPYDSE | 525 | GNWDDY | 530 |
| hzCAR123-26 | GYTFTSY | 520 | DPYDSE | 525 | GNWDDY | 530 |
| hzCAR123-27 | GYTFTSY | 520 | DPYDSE | 525 | GNWDDY | 530 |
| hzCAR123-28 | GYTFTSY | 520 | DPYDSE | 525 | GNWDDY | 530 |
| hzCAR123-29 | GYTFTSY | 520 | DPYDSE | 525 | GNWDDY | 530 |
| hzCAR123-30 | GYTFTSY | 520 | DPYDSE | 525 | GNWDDY | 530 |
| hzCAR123-31 | GYTFTSY | 520 | DPYDSE | 525 | GNWDDY | 530 |
| hzCAR123-32 | GYTFTSY | 520 | DPYDSE | 525 | GNWDDY | 530 |

TABLE 13

Light Chain Variable Domain CDRs according to the Chothia numbering scheme (Al-Lazikani et al., (1997) JMB 273, 927-948)

| Candidate | LCDR1 | ID | LCDR2 | ID | LCDR3 | ID |
|---|---|---|---|---|---|---|
| CAR123-2 | SQSISSY | 532 | AAS | 537 | GDSVPL | 542 |
| CAR123-3 | SQSISSY | 533 | AAS | 538 | GDSVPL | 543 |
| CAR123-4 | SQSISSY | 534 | AAS | 539 | GDSVPL | 544 |
| CAR123-1 | SQSISTY | 531 | AAF | 536 | GDSVPL | 541 |
| hzCAR123-1 | SKSISKD | 535 | SGS | 540 | HNKYPY | 555 |
| hzCAR123-2 | SKSISKD | 535 | SGS | 540 | HNKYPY | 555 |
| hzCAR123-3 | SKSISKD | 535 | SGS | 540 | HNKYPY | 555 |
| hzCAR123-4 | SKSISKD | 535 | SGS | 540 | HNKYPY | 555 |
| hzCAR123-5 | SKSISKD | 535 | SGS | 540 | HNKYPY | 555 |
| hzCAR123-6 | SKSISKD | 535 | SGS | 540 | HNKYPY | 555 |
| hzCAR123-7 | SKSISKD | 535 | SGS | 540 | HNKYPY | 555 |

TABLE 13-continued

Light Chain Variable Domain CDRs according to the Chothia numbering scheme (Al-Lazikani et al., (1997) JMB 273, 927-948)

| Candidate | LCDR1 | ID | LCDR2 | ID | LCDR3 | ID |
|---|---|---|---|---|---|---|
| hzCAR123-8 | SKSISKD | 535 | SGS | 540 | HNKYPY | 555 |
| hzCAR123-10 | SKSISKD | 535 | SGS | 540 | HNKYPY | 555 |
| hzCAR123-10 | SKSISKD | 535 | SGS | 540 | HNKYPY | 555 |
| hzCAR123-11 | SKSISKD | 535 | SGS | 540 | HNKYPY | 555 |
| hzCAR123-12 | SKSISKD | 535 | SGS | 540 | HNKYPY | 555 |
| hzCAR123-13 | SKSISKD | 535 | SGS | 540 | HNKYPY | 555 |
| hzCAR123-14 | SKSISKD | 535 | SGS | 540 | HNKYPY | 555 |
| hzCAR123-15 | SKSISKD | 535 | SGS | 540 | HNKYPY | 555 |
| hzCAR123-16 | SKSISKD | 535 | SGS | 540 | HNKYPY | 555 |
| hzCAR123-17 | SKSISKD | 535 | SGS | 540 | HNKYPY | 555 |
| hzCAR123-18 | SKSISKD | 535 | SGS | 540 | HNKYPY | 555 |
| hzCAR123-19 | SKSISKD | 535 | SGS | 540 | HNKYPY | 555 |
| hzCAR123-20 | SKSISKD | 535 | SGS | 540 | HNKYPY | 555 |
| hzCAR123-21 | SKSISKD | 535 | SGS | 540 | HNKYPY | 555 |
| hzCAR123-22 | SKSISKD | 535 | SGS | 540 | HNKYPY | 555 |
| hzCAR123-23 | SKSISKD | 535 | SGS | 540 | HNKYPY | 555 |
| hzCAR123-24 | SKSISKD | 535 | SGS | 540 | HNKYPY | 555 |
| hzCAR123-25 | SKSISKD | 535 | SGS | 540 | HNKYPY | 555 |
| hzCAR123-26 | SKSISKD | 535 | SGS | 540 | HNKYPY | 555 |
| hzCAR123-27 | SKSISKD | 535 | SGS | 540 | HNKYPY | 555 |
| hzCAR123-28 | SKSISKD | 535 | SGS | 540 | HNKYPY | 555 |
| hzCAR123-29 | SKSISKD | 535 | SGS | 540 | HNKYPY | 555 |
| hzCAR123-30 | SKSISKD | 535 | SGS | 540 | HNKYPY | 555 |
| hzCAR123-31 | SKSISKD | 535 | SGS | 540 | HNKYPY | 555 |
| hzCAR123-32 | SKSISKD | 535 | SGS | 540 | HNKYPY | 555 |

In embodiments, CD123 single chain variable fragments are generated and cloned into lentiviral CAR expression vectors with the intracellular CD3zeta domain and the intracellular co-stimulatory domain of 4-1BB. Names of exemplary fully human CD123 scFvs are depicted in Table 1. Names of exemplary humanized CD123 scFvs are depicted in Table 5.

TABLE 1

CAR-CD123 constructs

| Construct ID | CAR Nickname |
|---|---|
| EBB-C1357-F11 | CAR123-1 |
| EBB-C1358-B10 | CAR123-2 |
| EBB-C1358-D5 | CAR123-3 |
| EBB-C1357-C4 | CAR123-4 |

TABLE 5

CAR-CD123 constructs

| Construct ID | CAR Nickname |
|---|---|
| VH1_1-46_X_VK1_L8 | hzCAR-1 |
| VH1_1-46_X_VK3_L6 | hzCAR-2 |
| VH1_1-46_X_VK6_A14 | hzCAR-3 |
| VH1_1-46_X_VK4_B3 | hzCAR-4 |
| VK1_L8_X_VH1_1-46 | hzCAR-5 |
| VK3_L6_X_VH1_1-46 | hzCAR-6 |
| VK6_A14_X_VH1_1-46 | hzCAR-7 |
| VK4_B3_X_VH1_1-46 | hzCAR-8 |
| VH7_7-4.1_X_VK1_L8 | hzCAR-9 |
| VH7_7-4.1_X_VK3_L6 | hzCAR-10 |
| VH7_7-4.1_X_VK6_A14 | hzCAR-11 |
| VH7_7-4.1_X_VK4_B3 | hzCAR-12 |
| VK1_L8_X_VH7_7-4.1 | hzCAR-13 |
| VK3_L6_X_VH7_7-4.1 | hzCAR-14 |
| VK6_A14_X_VH7_7-4.1 | hzCAR-15 |
| VK4_B3_X_VH7_7-4.1 | hzCAR-16 |
| VH5_5-A_X_VK1_L8 | hzCAR-17 |
| VH5_5-A_X_VK3_L6 | hzCAR-18 |
| VH5_5-A_X_VK6_A14 | hzCAR-19 |
| VH5_5-A_X_VK4_B3 | hzCAR-20 |
| VK1_L8_X_VH5_5-A | hzCAR-21 |
| VK3_L6_X_VH5_5-A | hzCAR-22 |
| VK6_A14_X_VH5_5-A | hzCAR-23 |
| VK4_B3_X_VH5_5-A | hzCAR-24 |
| VH3_3-74_X_VK1_L8 | hzCAR-25 |
| VH3_3-74_X_VK3_L6 | hzCAR-26 |
| VH3_3-74_X_VK6_A14 | hzCAR-27 |
| VH3_3-74_X_VK4_B3 | hzCAR-28 |
| VK1_L8_X_VH3_3-74 | hzCAR-29 |
| VK3_L6_X_VH3_3-74 | hzCAR-30 |
| VK6_A14_X_VH3_3-74 | hzCAR-31 |
| VK4_B3_X_VH3_3-74 | hzCAR-32 |

In embodiments, the order in which the VL and VH domains appear in the scFv is varied (i.e., VL-VH, or VH-VL orientation), and where either three or four copies of the "G4S" (SEQ ID NO:25) subunit, in which each subunit comprises the sequence GGGGS (SEQ ID NO:25) (e.g., (G4S)$_3$ (SEQ ID NO:28) or (G4S)$_4$(SEQ ID NO:27)), connect the variable domains to create the entirety of the scFv domain, as shown in Table 2, Table 6, and Table 9.

The amino acid and nucleic acid sequences of the CD123 scFv domains and CD123 CAR molecules are provided in Table 2, Table 6, and Table 9. The amino acid sequences for the variable heavy chain and variable light chain for each scFv is also provided in Table 2 and Table 6. It is noted that the scFv fragments (SEQ ID NOs: 157-160, and 184-215) with a leader sequence (e.g., the amino acid sequence of SEQ ID NO: 1 or the nucleotide sequence of SEQ ID NO: 12) and without a leader sequence (SEQ ID NOs: 478, 480, 483, 485, and 556-587) are also encompassed by the present invention.

Leader (amino acid sequence)
(SEQ ID NO: 1)
MALPVTALLLPLALLLHAARP

Leader (nucleic acid sequence)
(SEQ ID NO: 12)
ATGGCCCTGCCTGTGACAGCCCTGCTGCTGCCTCTGGCTCTGCTGCTGC

ATGCCGCTAGACCC

CD8 hinge (amino acid sequence)
(SEQ ID NO: 2)
TTTPAPRPPTPAPTIASQPLSLRPEACRPAAGGAVHTRGLDFACD CD8 hinge (nucleic acid sequence)
(SEQ ID NO: 13)
ACCACGACGCCAGCGCCGCGACCACCAACACCGGCGCCCACCATCGCGT

CGCAGCCCCTGTCCCTGCGCCCAGAGGCGTGCCGGCCAGCGGCGGGGGG

CGCAGTGCACACGAGGGGGCTGGACTTCGCCTGTGAT

CD8 transmembrane (amino acid sequence)
(SEQ ID NO: 6)
IYIWAPLAGTCGVLLLSLVITLYC

CD8 transmembrane (nucleic acid sequence)
(SEQ ID NO: 17)
ATCTACATCTGGGCGCCCTTGGCCGGGACTTGTGGGGTCCTTCTCCTGT

CACTGGTTATCACCCTTTACTGC 4-1BB Intracellular domain (amino acid sequence)
(SEQ ID NO: 7)
KRGRKKLLYIFKQPFMRPVQTTQEEDGCSCRFPEEEEGGCEL 4-1BB Intracellular domain (nucleic acid sequence)
(SEQ ID NO: 18)
AAACGGGGCAGAAAGAAACTCCTGTATATATTCAAACAACCATTTATGA

GACCAGTACAAACTACTCAAGAGGAAGATGGCTGTAGCTGCCGATTTCC

AGAAGAAGAAGAAGGAGGATGTGAACTG

CD28 Intracellular domain (amino acid sequence)
(SEQ ID NO: 43)
RSKRSRLLHSDYMNMTPRRPGPTRKHYQPYAPPRDFAAYRS (SEQ ID NO: 43)

CD28 Intracellular domain (nucleotide sequence)
(SEQ ID NO: 44)
AGGAGTAAGAGGAGCAGGCTCCTGCACAGTGACTACATGAACATGACTC

CCCGCCGCCCCGGGCCCACCCGCAAGCATTACCAGCCCTATGCCCCACC

ACGCGACTTCGCAGCCTATCGCTCC (SEQ ID NO: 44)

ICOS Intracellular domain (amino acid sequence)
(SEQ ID NO: 45)
T K K K Y S S S V H D P N G E Y M F M R A V N T A

K K S R L T D V T L (SEQ ID NO: 45)

ICOS Intracellular domain (nucleotide sequence)
(SEQ ID NO: 46)
ACAAAAAAGAAGTATTCATCCAGTGTGCACGACCCTAACGGTGAATACA

TGTTCATGAGAGCAGTGAACACAGCCAAAAAATCCAGACTCACAGATGT

GACCCTA (SEQ ID NO: 46)

CD3 zeta domain (amino acid sequence)
(SEQ ID NO: 9)
RVKFSRSADAPAYKQGQNQLYNELNLGRREEYDVLDKRRGRDPEMGGKP

RRKNPQEGLYNELQKDKMAEAYSEIGMKGERRRGKGHDGLYQGLSTATK

DTYDALHMQALPPR

CD3 zeta (nucleic acid sequence)
(SEQ ID NO: 20)
AGAGTGAAGTTCAGCAGGAGCGCAGACGCCCCCGCGTACAAGCAGGGCC

AGAACCAGCTCTATAACGAGCTCAATCTAGGACGAAGAGAGGAGTACGA

TGTTTTGGACAAGAGACGTGGCCGGGACCCTGAGATGGGGGGAAAGCCG

AGAAGGAAGAACCCTCAGGAAGGCCTGTACAATGAACTGCAGAAAGATA

AGATGGCGGAGGCCTACAGTGAGATTGGGATGAAAGGCGAGCGCCGGAG

GGGCAAGGGGCACGATGGCCTTTACCAGGGTCTCAGTACAGCCACCAAG

GACACCTACGACGCCCTTCACATGCAGGCCCTGCCCCCTCGC

CD3 zeta domain (amino acid sequence; NCBI Reference Sequence NM_000734.3)
(SEQ ID NO: 10)
RVKFSRSADAPAYQQGQNQLYNELNLGRREEYDVLDKRRGRDPEMGGKP

RRKNPQEGLYNELQKDKMAEAYSEIGMKGERRRGKGHDGLYQGLSTATK

DTYDALHMQALPPR

CD3 zeta (nucleic acid sequence; NCBI Reference Sequence NM_000734.3);
(SEQ ID NO: 21)
AGAGTGAAGTTCAGCAGGAGCGCAGACGCCCCCGCGTACCAGCAGGGCC

AGAACCAGCTCTATAACGAGCTCAATCTAGGACGAAGAGAGGAGTACGA

TGTTTTGGACAAGAGACGTGGCCGGGACCCTGAGATGGGGGGAAAGCCG

AGAAGGAAGAACCCTCAGGAAGGCCTGTACAATGAACTGCAGAAAGATA

AGATGGCGGAGGCCTACAGTGAGATTGGGATGAAAGGCGAGCGCCGGAG

GGGCAAGGGGCACGATGGCCTTTACCAGGGTCTCAGTACAGCCACCAAG

GACACCTACGACGCCCTTCACATGCAGGCCCTGCCCCCTCGC

IgG4 Hinge (amino acid sequence)
(SEQ ID NO: 36)
ESKYGPPCPPCPAPEFLGGPSVFLFPPKPKDTLMISRTPEVTCVVVDVS

QEDPEVQFNWYVDGVEVHNAKTKPREEQFNSTYRVVSVLTVLHQDWLNG

KEYKCKVSNKGLPSSIEKTISKAKGQPREPQVYTLPPSQEEMTKNQVSL

TCLVKGFYPSDIAVEWESNGQPENNYKTTPPVLDSDGSFFLYSRLTVDK

SRWQEGNVFSCSVMHEALHNHYTQKSLSLSLGKM

IgG4 Hinge (nucleotide sequence)
(SEQ ID NO: 7)
GAGAGCAAGTACGGCCCTCCCTGCCCCCCTTGCCCTGCCCCCGAGTTCC

TGGGCGGACCCAGCGTGTTCCTGTTCCCCCCCAAGCCCAAGGACACCCT

GATGATCAGCCGGACCCCCGAGGTGACCTGTGTGGTGGTGGACGTGTCC

CAGGAGGACCCCGAGGTCCAGTTCAACTGGTACGTGGACGGCGTGGAGG

TGCACAACGCCAAGACCAAGCCCCGGGAGGAGCAGTTCAATAGCACCTA

CCGGGTGGTGTCCGTGCTGACCGTGCTGCACCAGGACTGGCTGAACGGC

AAGGAATACAAGTGTAAGGTGTCCAACAAGGGCCTGCCCAGCAGCATCG

AGAAAACCATCAGCAAGGCCAAGGGCCAGCCTCGGGAGCCCCAGGTGTA

CACCCTGCCCCCTAGCCAAGAGGAGATGACCAAGAACCAGGTGTCCCTG

ACCTGCCTGGTGAAGGGCTTCTACCCCAGCGACATCGCCGTGGAGTGGG

AGAGCAACGGCCAGCCCGAGAACAACTACAAGACCACCCCCCCTGTGCT

GGACAGCGACGGCAGCTTCTTCCTGTACAGCCGGCTGACCGTGGACAAG

AGCCGGTGGCAGGAGGGCAACGTCTTTAGCTGCTCCGTGATGCACGAGG

CCCTGCACAACCACTACACCCAGAAGAGCCTGAGCCTGTCCCTGGGCAA

GATG

In embodiments, these clones in Table 2 and 6 all contained a Q/K residue change in the signal domain of the co-stimulatory domain derived from CD3zeta chain.

TABLE 2

Exemplary CD123 CAR sequences

| Name | SEQ ID | Sequence |
|---|---|---|
| CAR123-2 NT | 40 | atggccctccctgtcaccgccctgctgcttccgctggctcttctgctccac<br>gccgctcggccccaagtgcaactcgtccaaagcggagcggaagtcaagaaa<br>cccggagcgagcgtgaaagtgtcctgcaaagcctccggctacacctttacg<br>ggctactacatgcactgggtgcgccaggccaggacagggtcttgaatgg<br>atgggatggatcaaccctaattcgggcggaactaactacgcacagaagttc<br>cagggggagagtgactctgactcgggataccccatctcaactgtctacatg<br>gaactctcccgcttgcggtcagatgatacggcagtgtactactgcgcccgc<br>gacatgaatatcctggctaccgtgccgttcgacatctgggacagggact<br>atggttactgtctcatcgggcggtggaggttcaggaggaggcggctcggga<br>ggcggaggttcggacattcagatgacccagtccccatcctctctgtcggcc<br>agcgtcggagataggtgaccattacctgtcgggcctcgcaaagcatctcc<br>tcgtacctcaactggtatcagcaaaagccgggaaaggcgcctaagctgctg<br>atctacgccgcttcgagcttgcaaagcggggtgccatccagattctcggga<br>tcaggctcaggaaccgacttcaccctgaccgtgaacagcctccagccggag<br>gactttgccacttactactgccagcaggagactccgtgccgcttacttc<br>ggggggggtaccccgcctggagatcaagaccactacccccagcaccgaggcca<br>cccaccccggctcctaccatcgcctcccagcctctgtccctgcgtccggag<br>gcatgtagacccgcagctggtggggccgtgcatacccgggtcttgacttc<br>gcctgcgatatctacatttgggcccctctggctggtacttgcgggtcctg<br>ctgctttcactcgtgatcactctttactgtaagcgcggtcggaagaagtg<br>ctgtacatcttttaagcaaccttcatgaggcctgtgcagactactcaagag<br>gaggacgctgttcatgccggttcccagaggaggaggaaggcggctgcgaa<br>ctgcgcgtgaaattcagcgcagcgcagatgctccagctacaagcagggg<br>cagaaccagctctacaacgaactcaatcttggtcggagagaggagtacgac<br>gtgctggacaagcggagaggacgggacccagaaatgggcggaagccgcgc<br>agaaagaatccaagagggcctgtacaacgagctccaaaaggataagatg<br>gcagaagcctatagcgagattggtatgaaagggaacgcagaagaggcaaa<br>ggccacgacggactgtaccagggactcagcaccgccaccaaggacacctat<br>gacgctcttcacatgcaggccctgccgcctcgg |
| CAR123-2 AA | 99 | MALPVTALLLPLALLLHAARPQVQLVQSGAEVKKPGASVKVSCKASGYTFT<br>GYYMHWVRQAPGQGLEWMGWINPNSGGTNYAQKFQGRVTLTRDTSISTVYM<br>ELSRLRSDDTAVYYCARDMNILATVPFDIWGQGTMVTVSSGGGGSGGGGSG<br>GGGSDIQMTQSPSSLSASVGDRVTITCRASQSISSYLNWYQQKPGKAPKLL<br>IYAASSLQSGVPSRFSGSGSGTDFTLTVNSLQPEDFATYYCQQGDSVPLTF<br>GGGTRLEIKTTTPAPRPPTPAPTIASQPLSLRPEACRPAAGGAVHTRGLDF<br>ACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYD<br>VLDKRRGRDPEMGGKPRRKNPQEGLYNELQKDKMAEAYSEIGMKGERRRGK<br>GHDGLYQGLSTATKDTYDALHMQALPPR |
| CAR123-2 scFv | 158 | MALPVTALLLPLALLLHAARPQVQLVQSGAEVKKPGASVKVSCKASGYTFT<br>GYYMHWVRQAPGQGLEWMGWINPNSGGTNYAQKFQGRVTLTRDTSISTVYM<br>ELSRLRSDDTAVYYCARDMNILATVPFDIWGQGTMVTVSSGGGGSGGGGSG<br>GGGSDIQMTQSPSSLSASVGDRVTITCRASQSISSYLNWYQQKPGKAPKLL<br>IYAASSLQSGVPSRFSGSGSGTDFTLTVNSLQPEDFATYYCQQGDSVPLTF<br>GGGTRLEIK |
| CAR123-2 VH | 217 | QVQLVQSGAEVKKPGASVKVSCKASGYTFTGYYMHWVRQAPGQGLEWMGWI<br>NPNSGGTNYAQKFQGRVTLTRDTSISTVYMELSRLRSDDTAVYYCARDMNI<br>LATVPFDIWGQGTMVTVSS |
| CAR123-2 VL | 276 | DIQMTQSPSSLSASVGDRVTITCRASQSISSYLNWYQQKPGKAPKLLIYAA<br>SSLQSGVPSRFSGSGSGTDFTLTVNSLQPEDFATYYCQQGDSVPLTFGGGT<br>RLEIK |
| CAR123-3 NT | 41 | atggccctccctgtcaccgccctgctgcttccgctggctcttctgctccac<br>gccgctcggccccaagtccaactcgttcaatccggcgcagaagtcaagag<br>ccaggagcatcagtgaaagtgtcctgcaaagcctcaggctacatcttcacg<br>ggatactacatccactgggtgcgccaggctccgggccagggccttgagtgg<br>atgggctggatcaaccctaactctggggaaccaactacgctcagaagttc<br>cagggggagggtcactatgactcgcgataccccatctccactgctacatg<br>gaactctcgggactgagatccgacgatcctgccgtgtactactgcgcccgg<br>gacatgaatatcttggcgaccgtgccgtttgacatttggggacagggcacc<br>ctcgtcactgtgtcgagcggtggaggaggctcggggggtggcggatcagga<br>gggggaggaagcgacatccagctgactcagagcccatcgtcgttgtccgcg<br>tcggtgggggatagagtgaccattacttgccgcgccagccagagcatctca<br>tcatatctgaattggtaccagcagaagcccggaaaggcccaaaactgctg<br>atctacgctgcaagcagcctccaatcgggagtgccgtcacggtctccggg<br>tccggttcgggaactgacttttaccctgaccgtgaattcgctgcaaccggag<br>gatttcgccacgtactactgtcagcaaggagactccgtgccgctgaccttc<br>ggtggaggcaccaaggtcgaaatcaagaccactacccccagcaccgaggcca<br>cccaccccggctcctaccatcgcctcccagcctctgtccctgcgtccggag<br>gcatgtagacccgcagctggtggggccgtgcatacccgggtcttgacttc<br>gcctgcgatatctacatttgggcccctctggctggtacttgcgggtcctg |

TABLE 2-continued

Exemplary CD123 CAR sequences

| Name | SEQ ID | Sequence |
|---|---|---|
| | | ctgctttcactcgtgatcactctttactgtaagcgcggtcggaagaagctg<br>ctgtacatctttaagcaaccttcatgaggcctgtgcagactactcaagag<br>gaggacggctgttcatgccggttcccagaggaggaggaaggcggctgcgaa<br>ctgcgcgtgaaattcagccgcagcgcagatgctccagctacaagcagggg<br>cagaaccagctctacaacgaactcaatcttggtcggagagaggagtacgac<br>gtgctggacaagcggagaggacgggacccagaaatgggcgggaagccgcgc<br>agaaagaatccccaagagggcctgtacaacgagctccaaaaggataagatg<br>gcagaagcctatagcgagattggtatgaaaggggaacgcagaagaggcaaa<br>ggccacgacggactgtaccagggactcagcaccgccaccaaggacacctat<br>gacgctcttcacatgcaggccctgccgcctcgg |
| CAR123-3<br>AA | 100 | MALPVTALLLPLALLLHAARPQVQLVQSGAEVKKPGASVKVSCKASGYIFT<br>GYYIHWVRQAPGQGLEWMGWINPNSGGTNYAQKFQGRVTMTRDTSISTAYM<br>ELSGLRSDDPAVYYCARDMNILATVPFDIWGQGTLVTVSSGGGGSGGGGSG<br>GGGSDIQLTQSPSSLSASVGDRVTITCRASQSISSYLNWYQQKPGKAPKLL<br>IYAASSLQSGVPSRFSGSGSGTDFTLTVNSLQPEDFATYYCQQGDSVPLTF<br>GGGTKVEIKTTTPAPRPPTPAPTIASQPLSLRPEACRPAAGGAVHTRGLDF<br>ACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYD<br>VLDKRRGRDPEMGGKPRRKNPQEGLYNELQKDKMAEAYSEIGMKGERRRGK<br>GHDGLYQGLSTATKDTYDALHMQALPPR |
| CAR123-3<br>scFv | 159 | MALPVTALLLPLALLLHAARPQVQLVQSGAEVKKPGASVKVSCKASGYIFT<br>GYYIHWVRQAPGQGLEWMGWINPNSGGTNYAQKFQGRVTMTRDTSISTAYM<br>ELSGLRSDDPAVYYCARDMNILATVPFDIWGQGTLVTVSSGGGGSGGGGSG<br>GGGSDIQLTQSPSSLSASVGDRVTITCRASQSISSYLNWYQQKPGKAPKLL<br>IYAASSLQSGVPSRFSGSGSGTDFTLTVNSLQPEDFATYYCQQGDSVPLTF<br>GGGTKVEIK |
| CAR123-3<br>VH | 218 | QVQLVQSGAEVKKPGASVKVSCKASGYIFTGYYIHWVRQAPGQGLEWMGWI<br>NPNSGGTNYAQKFQGRVTMTRDTSISTAYMELSGLRSDDPAVYYCARDMNI<br>LATVPFDIWGQGTLVTVSS |
| CAR123-3<br>VL | 277 | DIQLTQSPSSLSASVGDRVTITCRASQSISSYLNWYQQKPGKAPKLLIYAA<br>SSLQSGVPSRFSGSGSGTDFTLTVNSLQPEDFATYYCQQGDSVPLTFGGGT<br>KVEIK |
| CAR123-4<br>NT | 42 | atggccctccctgtcaccgccctgctgcttccgctggctcttctgctccac<br>gccgctcggccccaagtccaactccaacagtcaggcgcagaagtgaaaaag<br>agcggtgcatcggtgaaagtgtcatgcaaagcctcgggctacaccttcact<br>gactactatatgcactggctgcggcaggcaccgggacagggacttgagtgg<br>atgggatggatcaacccgaattcaggggacactaactacgcgcagaagttc<br>caggggagagtgaccctgacgagggacacctcaatttcgaccgtctacatg<br>gaattgtcgcgcctgagatcggacgatactgctgtgtactactgtgcccgc<br>gacatgaacatcctcgcgactgtgcctttttgatatctggggacaggggact<br>atggtcaccgtttcctccgcttccggtggcggaggctcgggaggccgggcc<br>tccggtggaggaggcagcgacatccagatgactcagagccttcctcgctg<br>agcgcctcagtgggagatcgcgtgaccatcacttgccgggccagcagtcc<br>atttcgtcctacctcaattggtaccagcagaagccgggaaaggcgcccaag<br>ctcttgatctacgctgcgagtccctgcaaagcggggtgccgagccgattc<br>tcgggttccggctcgggaaccgacttcactctgaccatctcatccctgcaa<br>ccagaggactttgccacctactactgccaacaaggagattctgtcccactg<br>acgttcggcggaggaaccaaggtcgaaatcaagaccactaccccagcaccg<br>aggccaccccaccccggctcctaccatcgcctcccagcctctgtccctgcgt<br>ccggaggcatgtagacccgcagctggtggggccgtgcataccgggtctt<br>gacttcgcctgcgatatctacatttgggcccctctggctggtacttgcggg<br>gtcctgctgctttcactcgtgatcactctttactgtaagcgcggtcggaag<br>aagctgctgtacatctttaagcaaccttcatgaggcctgtgcagactact<br>caagaggaggacggctgttcatgccggttcccagaggaggaggaaggcggc<br>tgcgaactgcgcgtgaaattcagccgcagcgcagatgctccagctacaag<br>cagggggcagaaccagctctacaacgaactcaatcttggtcggagagaggag<br>tacgacgtgctggacaagcggagaggacgggacccagaaatgggcgggaag<br>ccgcgcagaaagaatccccaagagggcctgtacaacgagctccaaaaggat<br>aagatggcagaagcctatagcgagattggtatgaaaggggaacgcagaaga<br>ggcaaaggccacgacggactgtaccagggactcagcaccgccaccaaggac<br>acctatgacgctcttcacatgcaggccctgccgcctcgg |
| CAR123-4<br>AA | 101 | MALPVTALLLPLALLLHAARPQVQLQQSGAEVKKSGASVKVSCKASGYTFT<br>DYYMHWLRQAPGQGLEWMGWINPNSGDTNYAQKFQGRVTLTRDTSISTVYM<br>ELSRLRSDDTAVYYCARDMNILATVPFDIWGQGTMVTVSSASGGGSGGRA<br>SGGGGSDIQMTQSPSSLSASVGDRVTITCRASQSISSYLNWYQQKPGKAPK<br>LLIYAASSLQSGVPSRFSGSGSGTDFTLTISSLQPEDFATYYCQQGDSVPL<br>TFGGGTKVEIKTTTPAPRPPTPAPTIASQPLSLRPEACRPAAGGAVHTRGL<br>DFACDIYIWAPLAGTCGVLLLSLVITLYCK |

TABLE 2-continued

Exemplary CD123 CAR sequences

| Name | SEQ ID | Sequence |
|---|---|---|
| CAR123-4 scFv | 160 | MALPVTALLLPLALLLHAARPQVQLQQSGAEVKKSGASVKVSCKASGYTFT DYYMHWLRQAPGQGLEWMGWINPNSGDTNYAQKFQGRVTLTRDTSISTVYM ELSRLRSDDTAVYYCARDMNILATVPFDIWGQGTMVTVSSASGGGGSGGRA SGGGGSDIQMTQSPSSLSASVGDRVTITCRASQSISSYLNWYQQKPGKAPK LLIYAASSLQSGVPSRFSGSGSGTDFTLTISSLQPEDFATYYCQQGDSVPL TFGGGTKVEIK |
| CAR123-4 VH | 219 | QVQLQQSGAEVKKSGASVKVSCKASGYTFTDYYMHWLRQAPGQGLEWMGWI NPNSGDTNYAQKFQGRVTLTRDTSISTVYMELSRLRSDDTAVYYCARDMNI LATVPFDIWGQGTMVTVSS |
| CAR123-4 VL | 278 | DIQMTQSPSSLSASVGDRVTITCRASQSISSYLNWYQQKPGKAPKLLIYAA SSLQSGVPSRFSGSGSGTDFTLTISSLQPEDFATYYCQQGDSVPLTFGGGT KVEIK |
| CAR123-1 NT | 39 | atggccctccctgtcaccgccctgctgcttccgctggctcttctgctccac gccgctcggccccaagtccaactcgtccagtcaggagcggaagtcaagaag cccggagcgtcagtcaaagtgtcatgcaaagcctcgggctacacttcact gggtactacatgcactgggtgcgccaggctccaggacagggactggaatgg atgggatggatcaacccgaactccggtggcaccaattacgcccagaagttc caggggagggtgaccatgactcgcgacacgtcgatcagcaccgcatacatg gagctgtcaagactccggtccgacgatactgccgtgtactactgcgcacgg gacatgaacattctggccaccgtgccttttgacatctggggtcagggaact atggttaccgtgtcctctggtggaggcggttccggcggggggggaagcgga ggcggtggaagcgacattcagatgacccagtcgccttcatccctttcggcg agcgtgggagatcgcgtcactatcacttgtcgggcctcgcagtccatctcc acctacctcaattggtaccagcagaagccaggaaaagcaccgaatctgctg atctacgccgcgttttccttgcaatcgggagtgccaagcagattcagcgga tcgggatcaggcactgatttcaccctcaccatcaactcgctgcaaccggag gatttcgctacgtactattgccaacaaggagacagcgtgccgctcaccttc ggcggagggactaagctggaaatcaagaccactaccccagcaccgaggcca cccaccccggctcctaccatcgcctcccagcctctgtccctgcgtccggag gcatgtagacccgcagctggtggggccgtgcatacccggggtcttgacttc gcctgcgatatctacatttgggcccctctggctggtacttgcggggtcctg ctgctttcactcgtgatcactcttactgtaagcgcggtcggaagaagctg ctgtacatcttcaagcaaccccttcatgaggcctgtgcagactactcaagag gaggacgctgttcatgccggttcccagaggaggaggaaggcggctgcgaa ctgcgcgtgaaattcagcgcagcgcagatgctccagctacaagcagggg cagaaccagctctacaacgaactcaatcttggtcggagagaggagtacgac gtgctggacaagcggagaggacgggacccagaaatgggcgggaagccgcgc agaaagaatcccaagagggcctgtacaacgagctccaaaaggataagatg gcagaagcctatagcgagattggtatgaaaggggaacgcagaagaggcaaa ggccacgacggactgtaccagggactcagcaccgccaccaaggacacctat gacgctcttcacatgcaggccctgccgcctcgg |
| CAR123-1 AA | 98 | malpvtalllplallhaarpqvqlvqsgaevkkpgasvkvsckasgytft gyymhwvrqapgqglewmgwinpnsggtnyaqkfqgrvtmtrdtsistaym elsrlrsddtavyycardmnilatvpfdiwgqgtmvtvssggggsggggsg gggsdiqmtqspsslsasvgdrvtitcrasqsistylnwyqqkpgkapnll iyaafslqsgvpsrfsgsgsgtdftltinslqpedfatyycqqgdsvpltf gggtkleiktttpaprppatpaptiasqplslrpeacrpaaggavhtrgldf acdiyiwaplagtcgvlllslvitlyckrgrkkllyifkqpfmrpvqttqe edgeserfpeeeeggcelrvkfsrsadapaykqgqnqlynelnlgrreeyd vldkrrgrdpemggkprrknpqeglynelqkdkmaeayseigmkgerrrgk ghdglyqglstatkdtydalhmqalppr |
| CAR123-1 scFv | 157 | malpvtalllplallhaarpqvqlvqsgaevkkpgasvkvsckasgytft gyymhwvrqapgqglewmgwinpnsggtnyaqkfqgrvtmtrdtsistaym elsrlrsddtavyycardmnilatvpfdiwgqgtmvtvssggggsggggsg gggsdiqmtqspsslsasvgdrvtitcrasqsistylnwyqqkpgkapnll iyaafslqsgvpsrfsgsgsgtdftltinslqpedfatyycqqgdsvpltf gggtkleik |
| CAR123-1 VH | 216 | QVQLVQSGAEVKKPGASVKVSCKASGYTFTGYYMHWVRQAPGQGLEWMGWI NPNSGGTNYAQKFQGRVTMTRDTSISTAYMELSRLRSDDTAVYYCARDMNI LATVPFDIWGQGTMVTVSS |
| CAR123-1 VL | 275 | DIQMTQSPSSLSASVGDRVTITCRASQSISTYLNWYQQKPGKAPNLLIYAA FSLQSGVPSRFSGSGSGTDFTLTINSLQPEDFATYYCQQGDSVPLTFGGGT KLEIK |

TABLE 6

Humanized CD123 CAR Sequences

| Name | SEQ ID | Sequence |
|---|---|---|
| hzCAR123-1 NT | 66 | ATGGCCCTCCCTGTCACCGCCCTGCTGCTTCCGCTGGCTCTTCTGCTCCACGCCGCTCGGC
CCCAAGTGCAGCTGGTCCAGTCGGGAGCCGAAGTCAAGAAGCCCGGCGCTAGCGTGAAAGT
GTCCTGCAAAGCCTCCGGGTACACATTCACCTCCTACTGGATGAATTGGGTCAGACAGGCG
CCCGGCCAGGGACTCGAGTGGATGGGAAGGATTGATCCTTACGACTCCGAAACCCATTACA
ACCAGAAGTTCAAGGACCGCGTGACCATGACTGTGGATAAGTCCACTTCCACCGCTTACAT
GGAGCTGTCCAGCCTGCGCTCCGAGGATACCGCAGTGTACTACTGCGCCCGGGGAAACTGG
GACGACTATTGGGGACAGGGAACTACCGTGACCGTGTCAAGCGGGGGTGGCGGTAGCGGAG
GAGGGGGCTCCGGCGGCGGCGGCTCAGGGGGCGGAGGAAGCGACGTGCAGCTCACCCAGTC
GCCCTCATTTCTGTCGGCCTCAGTGGGAGACAGAGTGACCATTACTTGTCGGGCCTCCAAG
AGCATCTCCAAGGACCTGGCCTGGTATCAGCAGAAGCCAGGAAAGGCGCCTAAGTTGCTCA
TCTACTCGGGGTCGACCCTGCAATCTGGCGTGCCGTCCCGGTTCTCCGGTTCGGAAGCGG
TACCGAATTCACCCTTACTATCTCCTCCCTGCAACCGGAGACTTCGCCACCTACTACTGC
CAACAGCACAACAAGTACCCGTACACTTTCGGGGGTGGCACGAAGGTCGAAATCAAGACCA
CTACCCCAGCACCGAGGCCACCCACCCCGGCTCCTACCATCGCCTCCCAGCCTCTGTCCCT
GCGTCCGGAggcatgtagacccgcagctggtggggccgtgcatacccggggtcttgacttc
gcctgcgatatctacatttgggcccctctggctggtacttgcggggtcctgctgctttcac
tcgtgatcactctttactgtaagcgcggtcggaagaagctgctgtacatctttaagcaacc
cttcatgaggcctgtgcagactactcaagaggaggacggctgttcatgccggttcccagag
gaggaggaaggcggctgcgaactgcgcgtgaaattcagccgcagcgcagatgctccagcct
acaagcaggggcagaaccagctctacaacgaactcaatcttggtcggagagaggagtacga
cgtgctggacaagcggagaggacgggacccagaaatgggcgggaagccgcgcagaaagaat
ccccaagagggcctgtacaacgagctccaaaaggataagatggcagaagcctatagcgaga
ttggtatgaaggggaacgcagaagaggcaaaggccacgacggactgtaccagggactcag
caccgccaccaaggacacctatgacgctcttcacatgcaggccctgccgcctcgg |
| hzCAR123-1 AA | 125 | MALPVTALLLPLALLLHAARPQVQLVQSGAEVKKPGASVKVSCKASGYTFTSYWMNWVRQA
PGQGLEWMGRIDPYDSETHYNQKFKDRVTMTVDKSTSTAYMELSSLRSEDTAVYYCARGNW
DDYWGQGTTVTVSSGGGGSGGGGSGGGGSDVQLTQSPSFLSASVGDRVTITCRASK
SISKDLAWYQQKPGKAPKLLIYSGSTLQSGVPSRFSGSGSGTEFTLTISSLQPEDFATYYC
QQHNKYPYTFGGGTKVEIKTTTPAPRPPTPAPTIASQPLSLRPEACRPAAGGAVHTRGLDF
ACDIYIWAPLAGTCGVLLLSLVITLYCKRGRKKLLYIFKQPFMRPVQTTQEEDGCSCRFPE
EEEGGCELRVKFSRSADAPAYKQGQNQLYNELNLGRREEYDVLDKRRGRDPEMGGKPRRKN
PQEGLYNELQKDKMAEAYSEIGMKGERRRGKGHDGLYQGLSTATKDTYDALHMQALPPR |
| hzCAR123-1 scFv | 184 | MALPVTALLLPLALLLHAARPQVQLVQSGAEVKKPGASVKVSCKASGYTFTSYWMNWVRQA
PGQGLEWMGRIDPYDSETHYNQKFKDRVTMTVDKSTSTAYMELSSLRSEDTAVYYCARGNW
DDYWGQGTTVTVSSGGGGSGGGGSGGGGSDVQLTQSPSFLSASVGDRVTITCRASK
SISKDLAWYQQKPGKAPKLLIYSGSTLQSGVPSRFSGSGSGTEFTLTISSLQPEDFATYYC
QQHNKYPYTFGGGTKVEIK |
| hzCAR123-1 VH | 243 | QVQLVQSGAEVKKPGASVKVSCKASGYTFTSYWMNWVRQAPGQGLEWMGRIDPYDSETHYN
QKFKDRVTMTVDKSTSTAYMELSSLRSEDTAVYYCARGNWDDYWGQGTTVTVSS |
| hzCAR123-1 VL | 302 | DVQLTQSPSFLSASVGDRVTITCRASKSISKDLAWYQQKPGKAPKLLIYSGSTLQSGVPSR
FSGSGSGTEFTLTISSLQPEDFATYYCQQHNKYPYTFGGGTKVEIK |
| hzCAR123-2 NT | 67 | ATGGCCCTCCCTGTCACCGCCCTGCTGCTTCCGCTGGCTCTTCTGCTCCACGCCGCTCGGC
CCCAAGTGCAGCTGGTCCAGTCGGGAGCCGAAGTCAAGAAGCCCGGCGCTAGCGTGAAAGT
GTCCTGCAAAGCCTCCGGGTACACATTCACCTCCTACTGGATGAATTGGGTCAGACAGGCG
CCCGGCCAGGGACTCGAGTGGATGGGAAGGATTGATCCTTACGACTCCGAAACCCATTACA
ACCAGAAGTTCAAGGACCGCGTGACCATGACTGTGGATAAGTCCACTTCCACCGCTTACAT
GGAGCTGTCCAGCCTGCGCTCCGAGGATACCGCAGTGTACTACTGCGCCCGGGGAAACTGG
GACGACTATTGGGGACAGGGAACTACCGTGACCGTGTCAAGCGGGGGTGGCGGTAGCGGAG
GAGGGGGCTCCGGCGGCGGCGGCTCAGGGGGCGGAGGAAGCGAAGTGGTGCTGACCCAGTC
GCCCGCAACCCTCTCTCTGTCGCCGGGAGAACGCGCCACTCTTTCCTGTCGGCGTCCAAG
AGCATCTCAAAGGACCTCGCCTGGTACCAGCAGAAGCCTGGTCAAGCCCGCGGCTGCTGA
TCTACTCCGGCTCCACGCTGCAATCAGGAATCCCAGCCAGATTTTCCGGTTCGGGGTCGGG
GACTGACTTCACCTTGACCATTAGCTCGCTGGAACCTGAGGACTTCGCCGTGTATTACTGC
CAGCAGCACAACAAGTACCCGTACACCTTCGGAGGCGGTACTAAGGTCGAGATCAAGACCA
CTACCCCAGCACCGAGGCCACCCACCCCGGCTCCTACCATCGCCTCCCAGCCTCTGTCCCT
GCGTCCGGAggcatgtagacccgcagctggtggggccgtgcatacccggggtcttgacttc
gcctgcgatatctacatttgggcccctctggctggtacttgcggggtcctgctgctttcac
tcgtgatcactctttactgtaagcgcggtcggaagaagctgctgtacatctttaagcaacc
cttcatgaggcctgtgcagactactcaagaggaggacggctgttcatgccggttcccagag
gaggaggaaggcggctgcgaactgcgcgtgaaattcagccgcagcgcagatgctccagcct
acaagcaggggcagaaccagctctacaacgaactcaatcttggtcggagagaggagtacga
cgtgctggacaagcggagaggacgggacccagaaatgggcgggaagccgcgcagaaagaat
ccccaagagggcctgtacaacgagctccaaaaggataagatggcagaagcctatagcgaga
ttggtatgaaggggaacgcagaagaggcaaaggccacgacggactgtaccagggactcag
caccgccaccaaggacacctatgacgctcttcacatgcaggccctgccgcctcgg |
| hzCAR123-2 AA | 126 | MALPVTALLLPLALLLHAARPQVQLVQSGAEVKKPGASVKVSCKASGYTFTSYWMNWVRQ
APGQGLEWMGRIDPYDSETHYNQKFKDRVTMTVDKSTSTAYMELSSLRSEDTAVYYCARG
NWDDYWGQGTTVTVSSGGGGSGGGGSGGGGSGGGGSEVVLTQSPATLSLSPGERATLSCR
ASKSISKDLAWYQQKPGQAPRLLIYSGSTLQSGIPARFSGSGSGTDFTLTISSLEPEDFA |

TABLE 6-continued

Humanized CD123 CAR Sequences

| Name | SEQ ID | Sequence |
|---|---|---|
| | | VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-2 scFv | 185 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIK |
| hzCAR123-2 VH | 244 | QVQLVQSGAEVKKPGASVKVSCKASGYTFTSYWMNWVRQAPGQGLEWMGRIDPYDSETHYN<br>QKFKDRVTMTVDKSTSTAYMELSSLRSEDTAVYYCARGNWDDYWGQGTTVTVSS |
| hzCAR123-2 VL | 303 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-3 NT | 68 | ATGGCCCTCCCTGTCACCGCCCTGCTGCTTCCGCTGGCTCTTCTGCTCCACGCCGCTCGGC<br>CCCAAGTGCAGCTGGTCCAGTCGGGAGCCGAAGTCAAGAAGCCCGGCGCTAGCGTGAAAGT<br>GTCCTGCAAAGCCTCCGGGTACACATTCACCTCCTACTGGATGAATTGGGTCAGACAGGCG<br>CCCGGCCAGGGACTCGAGTGGATGGGAAGGATTGATCCTTACGACTCCGAAACCCATTACA<br>ACCAGAAGTTCAAGGACCGCGTGACCATGACTGTGGATAAGTCCACTTCCACCGCTTACAT<br>GGAGCTGTCCAGCCTGCGCTCCGAGGATACCGCAGTGTACTACTGCGCCCGGGGAAACTGG<br>GACGACTATTGGGACAGGGAACTACCGTGACCGTGTCAAGCGGGGGTGGCGGTAGCGGAG<br>GAGGGGGCTCCGGCGGCGGCGGCTCAGGGGGCGGAGGAAGCGACGTCGTGATGACCCAGTC<br>ACCGGCATTCCTGTCCGTGACTCCCGGAGAAAAGGTCACGATTACTTGCCGGGCGTCCAAG<br>AGCATCTCCAAGGACCTCGCCTGGTACCAACAGAAGCCGGACCAGGCCCCTAAGCTGTTGA<br>TCTACTCGGGGTCCACCCTTCAATCGGGAGTGCCATCGCGGTTTAGCGGTTCGGGTTCTGG<br>GACCGACTTCACTTTCACCATCTCCTCACTGGAAGCCGAGGATGCCGCCACTTACTACTGT<br>CAGCAGCACAACAAGTATCCGTACACCTTCGGAGGCGGTACCAAAGTGGAGATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcataccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-3AA | 127 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-3 scFv | 186 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIK |
| hzCAR123-3 VH | 245 | QVQLVQSGAEVKKPGASVKVSCKASGYTFTSYWMNWVRQAPGQGLEWMGRIDPYDSETHYN<br>QKFKDRVTMTVDKSTSTAYMELSSLRSEDTAVYYCARGNWDDYWGQGTTVTVSS |
| hzCAR123-3 VL | 304 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-4 NT | 69 | ATGGCCCTCCCTGTCACCGCCCTGCTGCTTCCGCTGGCTCTTCTGCTCCACGCCGCTCGGC<br>CCCAAGTGCAGCTGGTCCAGTCGGGAGCCGAAGTCAAGAAGCCCGGCGCTAGCGTGAAAGT<br>GTCCTGCAAAGCCTCCGGGTACACATTCACCTCCTACTGGATGAATTGGGTCAGACAGGCG<br>CCCGGCCAGGGACTCGAGTGGATGGGAAGGATTGATCCTTACGACTCCGAAACCCATTACA<br>ACCAGAAGTTCAAGGACCGCGTGACCATGACTGTGGATAAGTCCACTTCCACCGCTTACAT<br>GGAGCTGTCCAGCCTGCGCTCCGAGGATACCGCAGTGTACTACTGCGCCCGGGGAAACTGG<br>GACGACTATTGGGACAGGGAACTACCGTGACCGTGTCAAGCGGGGGTGGCGGTAGCGGAG<br>GAGGGGGCTCCGGCGGCGGCGGCTCAGGGGGCGGAGGAAGCGACGTGGTCATGACTCAGTC<br>CCCGGACTCACTCGCGGTGTCGCTTGAGAGAGAGCGACCATCAACTGTCGGGCCTCAAAG<br>AGCATCAGCAAGGACCTGGCCTGGTACCAGCAGAAGCCGGGACAGCCGCCAAAGCTGCTGA |

TABLE 6-continued

Humanized CD123 CAR Sequences

| Name | SEQ ID | Sequence |
|---|---|---|
| | | TCTACTCCGGGTCCACCTTGCAATCTGGTGTCCCTGACCGGTTCTCCGGTTCCGGGTCGGG<br>TACCGACTTCACGCTCACTATTTCGTCGCTGCAAGCCGAAGATGTGGCCGTGTACTATTGC<br>CAACAGCACAACAAGTACCCCTACACTTTTGGCGGAGGCACCAAGGTGGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-4 AA | 128 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-4 scFv | 187 | MALPVTALLLPLALLLHAARPQVQLVQSGAEVKKPGASVKVSCKASGYTFTSYWMNWVRQ<br>APGQGLEWMGRIDPYDSETHYNQKFKDRVTMTVDKSTSTAYMELSSLRSEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIK |
| hzCAR123-4 VH | 246 | QVQLVQSGAEVKKPGASVKVSCKASGYTFTSYWMNWVRQAPGQGLEWMGRIDPYDSETHYN<br>QKFKDRVTMTVDKSTSTAYMELSSLRSEDTAVYYCARGNWDDYWGQGTTVTVSS |
| hzCAR123-4 VL | 305 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |
| hzCAR123-5 NT | 70 | ATGGCCCTCCCTGTCACCGCCCTGCTGCTTCCGCTGGCTCTTCTGCTCCACGCCGCTCGGC<br>CCGACGTGCAGCTCACCCAGTCGCCCTCATTTCTGTCGGCCTCAGTGGGAGACAGAGTGAC<br>CATTACTTGTCGGGCCTCCAAGAGCATCTCCAAGGACCTGGCCTGGTATCAGCAGAAGCCA<br>GGAAAGGCGCCTAAGTTGCTCATCTACTCGGGGTCGACCCTGCAATCTGGCGTGCCGTCCC<br>GGTTCTCCGGTTCGGGAAGCGGTACCGAATTCACCCTTACTATCTCCTCCCTGCAACCGGA<br>GGACTTCGCCACCTACTACTGCCAACAGCACAACAAGTACCCGTACACTTTCGGGGGTGGC<br>ACGAAGGTCGAAATCAAGGGGGGTGGCGGTAGCGGAGGAGGGGGCTCCGGCGGCGGCGGCT<br>CAGGGGGCGGAGGAAGCCAAGTGCAGCTGGTCCAGTCGGGAGCCGAAGTCAAGAAGCCCGG<br>CGCTAGCGTGAAAGTGTCCTGCAAAGCCTCCGGGTACACATTCACCTCCTACTGGATGAAT<br>TGGGTCAGACAGGCGCCCGGCCAGGGACTCGAGTGGATGGGAAGGATTGATCCTTACGACT<br>CCGAAACCCATTACAACCAGAAGTTCAAGGACCGCGTGACCATGACTGTGGATAAGTCCAC<br>TTCCACCGCTTACATGGAGCTGTCCAGCCTGCGCTCCGAGGATACCGCAGTGTACTACTGC<br>GCCCGGGGAAACTGGGACGACTATTGGGACAGGGAACTACCGTGACCGTGTCAAGCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-5 AA | 129 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSQVQLVQSGAEVKKPGASVKVSCKASGYTFTSY<br>WMNWVRQAPGQGLEWMGRIDPYDSETHYNQKFKDRVTMTVDKSTSTAYMELSSLRSEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-5 scFv | 188 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSQVQLVQSGAEVKKPGASVKVSCKASGYTFTSY |

TABLE 6-continued

Humanized CD123 CAR Sequences

| Name | SEQ ID | Sequence |
|---|---|---|
| | | WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-5 VH | 247 | QVQLVQSGAEVKKPGASVKVSCKASGYTFTSYWMNWVRQAPGQGLEWMGRIDPYDSETHYN QKFKDRVTMTVDKSTSTAYMELSSLRSEDTAVYYCARGNWDDYWGQGTTVTVSS |
| hzCAR123-5 VL | 306 | DVQLTQSPSFLSASVGDRVTITCRASKSISKDLAWYQQKPGKAPKLLIYSGSTLQSGVPSR FSGSGSGTEFTLTISSLQPEDFATYYCQQHNKYPYTFGGGTKVEIK |
| hzCAR123-6 NT | 71 | ATGGCCCTCCCTGTCACCGCCCTGCTGCTTCCGCTGGCTCTTCTGCTCCACGCCGCTCGGC CCGAAGTGGTGCTGACCCAGTCGCCCGCAACCCTCTCTCTGTCGCCGGGAGAACGCGCCAC TCTTTCCTGTCGGGCGTCCAAGAGCATCTCAAAGGACCTCGCCTGGTACCAGCAGAAGCCT GGTCAAGCCCCGCGGCTGCTGATCTACTCCGGCTCCACGCTGCAATCAGGAATCCCAGCCA GATTTTCCGGTTCGGGGTCGGGACTGACTTCACCTTGACCATTAGCTCGCTGGAACCTGA GGACTTCGCCGTGTATTACTGCCAGCAGCACAACAAGTACCCGTACACCTTCGGAGGCGGT ACTAAGGTCGAGATCAAGGGGGGTGGCGGTAGCGGAGGAGGGGGCTCCGGCGGCGGCGGCT CAGGGGGCGGAGGAAGCCAAGTGCAGCTGGTCCAGTCGGGAGCCGAAGTCAAGAAGCCCGG CGCTAGCGTGAAAGTGTCCTGCAAAGCCTCCGGGTACACATTCACCTCCTACTGGATGAAT TGGGTCAGACAGGCGCCCGGCCAGGGACTCGAGTGGATGGGAAGGATTGATCCTTACGACT CCGAAACCCATTACAACCAGAAGTTCAAGGACGCGTGACCATGACTGTGGATAAGTCCAC TTCCACCGCTTACATGGAGCTGTCCAGCCTGCGCTCCGAGGATACCGCAGTGTACTACTGC GCCCGGGGAAACTGGGACGACTATTGGGGACAGGGAACTACCGTGACCGTGTCAAGCACCA CTACCCCAGCACCGAGGCCACCCACCCCGGCTCCTACCATCGCCTCCCAGCCTCTGTCCCT GCGTCCGGAggcatgtagacccgcagctggtggggccgtgcatacccggggtcttgacttc gcctgcgatatctacatttgggccctctggctggtacttgcggggtcctgctgctttcac tcgtgatcactcttttactgtaagcgcggtcggaagaagctgctgtacatctttaagcaacc cttcatgaggcctgtgcagactactcaagaggaggacggctgttcatgccggttcccagag gaggaggaaggcggctgcgaactgcgcgtgaaattcagccgcagcgcagatgctccagcct acaagcaggggcagaaccagctctacaacgaactcaatcttggtcggagagaggagtacga cgtgctggacaagcggagaggacgggacccagaaatgggcggaagccgcgcagaaagaat ccccaagagggcctgtacaacgagctccaaaaggataagatggcagaagcctatagcgaga ttggtatgaaggggaacgcagaagaggcaaaggccacgacggactgtaccagggactcag caccgccaccaaggacacctatgacgctcttcacatgcaggccctgccgcctcgg |
| hzCAR123-6 AA | 130 | MALPVTALLLPLALLLHAARPEVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-6 scFv | 189 | MALPVTALLLPLALLLHAARPEVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-6 VH | 248 | QVQLVQSGAEVKKPGASVKVSCKASGYTFTSYWMNWVRQAPGQGLEWMGRIDPYDSETHYN QKFKDRVTMTVDKSTSTAYMELSSLRSEDTAVYYCARGNWDDYWGQGTTVTVSS |
| hzCAR123-6 VL | 307 | EVVLTQSPATLSLSPGERATLSCRASKSISKDLAWYQQKPGQAPRLLIYSGSTLQSGIPAR FSGSGSGTDFTLTISSLEPEDFAVYYCQQHNKYPYTFGGGTKVEIK |
| hzCAR123-7 NT | 72 | ATGGCCCTCCCTGTCACCGCCCTGCTGCTTCCGCTGGCTCTTCTGCTCCACGCCGCTCGGC CCGACGTCGTGATGACCCAGTCACCGGCATTCCTGTCCGTGACTCCCGGAGAAAAGGTCAC GATTACTTGCCGGGCGTCCAAGAGCATCTCCAAGGACCTCGCCTGGTACCAACAGAAGCCG GACCAGGCCCCTAAGCTGTTGATCTACTCGGGGTCCACCCTTCAATCGGGAGTGCCATCGC GGTTTAGCGGTTCGGGTTCTGGGACCGACTTCACTTTCACCATCTCCTCACTGGAAGCCGA GGATGCCGCCACTTACTACTGTCAGCAGCACAACAAGTATCCGTACACCTTCGGAGGCGGT ACCAAAGTGGAGATCAAGGGGGGTGGCGGTAGCGGAGGAGGGGGCTCCGGCGGCGGCGGCT CAGGGGGCGGAGGAAGCCAAGTGCAGCTGGTCCAGTCGGGAGCCGAAGTCAAGAAGCCCGG CGCTAGCGTGAAAGTGTCCTGCAAAGCCTCCGGGTACACATTCACCTCCTACTGGATGAAT TGGGTCAGACAGGCGCCCGGCCAGGGACTCGAGTGGATGGGAAGGATTGATCCTTACGACT CCGAAACCCATTACAACCAGAAGTTCAAGGACGCGTGACCATGACTGTGGATAAGTCCAC TTCCACCGCTTACATGGAGCTGTCCAGCCTGCGCTCCGAGGATACCGCAGTGTACTACTGC GCCCGGGGAAACTGGGACGACTATTGGGGACAGGGAACTACCGTGACCGTGTCAAGCACCA CTACCCCAGCACCGAGGCCACCCACCCCGGCTCCTACCATCGCCTCCCAGCCTCTGTCCCT GCGTCCGGAggcatgtagacccgcagctggtggggccgtgcatacccggggtcttgacttc gcctgcgatatctacatttgggccctctggctggtacttgcggggtcctgctgctttcac tcgtgatcactcttttactgtaagcgcggtcggaagaagctgctgtacatctttaagcaacc cttcatgaggcctgtgcagactactcaagaggaggacggctgttcatgccggttcccagag gaggaggaaggcggctgcgaactgcgcgtgaaattcagccgcagcgcagatgctccagcct |

TABLE 6-continued

Humanized CD123 CAR Sequences

| Name | SEQ ID | Sequence |
|---|---|---|
| | | acaagcaggggcagaaccagctctacaacgaactcaatcttggtcggagagaggagtacga cgtgctggacaagcggagaggacgggacccagaaatgggcgggaagccgcgcagaaagaat ccccaagagggcctgtacaacgagctccaaaaggataagatggcagaagcctatagcgaga ttggtatgaaagggaacgcagaagaggcaaaggccacgacggactgtaccagggactcag caccgccaccaaggacacctatgacgctcttcacatgcaggccctgccgcctcgg |
| hzCAR123-7 AA | 131 | MALPVTALLLPLALLLHAARPDVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-7 scFv | 190 | MALPVTALLLPLALLLHAARPDVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-7 VH | 249 | QVQLVQSGAEVKKPGASVKVSCKASGYTFTSYWMNWVRQAPGQGLEWMGRIDPYDSETHYN QKFKDRVTMTVDKSTSTAYMELSSLRSEDTAVYYCARGNWDDYWGQGTTVTVSS |
| hzCAR123-7 VL | 308 | DVVMTQSPAFLSVTPGEKVTITCRASKSISKDLAWYQQKPDQAPKLLIYSGSTLQSGVPSR FSGSGSGTDFTFTISSLEAEDAATYYCQQHNKYPYTFGGGTKVEIK |
| hzCAR123-8 NT | 73 | ATGGCCCTCCCTGTCACCGCCCTGCTGCTTCCGCTGGCTCTTCTGCTCCACGCCGCTCGGC CCGACGTGGTCATGACTCAGTCCCCGGACTCACTCGCGGTGTCGCTTGGAGAGAGAGCGAC CATCAACTGTCGGGCCTCAAAGAGCATCAGCAAGGACCTGGCCTGGTACCAGCAGAAGCCG GGACAGCCGCCAAAGCTGCTGATCTACTCCGGGTCCACCTTGCAATCTGGTGTCCCTGACC GGTTCTCCGGTTCCGGGTCGGGTACCGACTTCACGCTCACTATTTCGTCGCTGCAAGCCGA AGATGTGGCCGTGTACTATTGCCAACAGCACAACAAGTACCCCTACACTTTTGGCGGAGGC ACCAAGGTGGAAATCAAGGGGGGTGGCGGTAGCGGAGGAGGGGGCTCCGGCGGCGGCGGCT CAGGGGGCGGAGGAAGCCAAGTGCAGCTGGTCCAGTCGGGAGCCGAAGTCAAGAAGCCCGG CGCTAGCGTGAAAGTGTCCTGCAAAGCCTCCGGGTACACATTCACCTTCCTACTGGATGAAT TGGGTCAGACAGGCGCCCGGCCAGGGACTCGAGTGGATGGGAAGGATTGATCCTTACGACT CCGAAACCCATTACAACCAGAAGTTCAAGGACCGCGTGACCATGACTGTGGATAAGTCCAC TTCCACCGCTTACATGGAGCTGTCCAGCCTGCGCTCCGAGGATACCGCAGTGTACTACTGC GCCCGGGGAAACTGGGACGACTATTGGGGACAGGGAACTACCGTGACCGTGTCAAGCACCA CTACCCCAGCACCGAGGCCACCCACCCCGGCTCCTACCATCGCCTCCCAGCCTCTGTCCCT GCGTCCGGAggcatgtagacccgcagctggtgggccgtgcatacccggggtcttgacttc gcctgcgatatctacatttgggcccctctggctggtacttgcggggtcctgctgctttcac tcgtgatcactcttttactgtaagcgcggtcggaagaagctgctgtacatctttaagcaacc cttcatgaggcctgtgcagactactcaagaggaggacggctgttcatgccggttcccagag gaggaggaaggcggctgcgaactgcgcgtgaaattcagccgcagcgcagatgctccagcct acaagcaggggcagaaccagctctacaacgaactcaatcttggtcggagagaggagtacga cgtgctggacaagcggagaggacgggacccagaaatgggcgggaagccgcgcagaaagaat ccccaagagggcctgtacaacgagctccaaaaggataagatggcagaagcctatagcgaga ttggtatgaaagggaacgcagaagaggcaaaggccacgacggactgtaccagggactcag caccgccaccaaggacacctatgacgctcttcacatgcaggccctgccgcctcgg |
| hzCAR123-8 AA | 132 | MALPVTALLLPLALLLHAARPDVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSSTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKGHDGLYQGLSTATKDTYDALHM QALPPR |
| hzCAR123-8 scFv | 191 | MALPVTALLLPLALLLHAARPDVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-8 VH | 250 | QVQLVQSGAEVKKPGASVKVSCKASGYTFTSYWMNWVRQAPGQGLEWMGRIDPYDSETHYN QKFKDRVTMTVDKSTSTAYMELSSLRSEDTAVYYCARGNWDDYWGQGTTVTVSS |
| hzCAR123-8 VL | 309 | DVVMTQSPDSLAVSLGERATINCRASKSISKDLAWYQQKPGQPPKLLIYSGSTLQSGVPDR FSGSGSGTDFTLTISSLQAEDVAVYYCQQHNKYPYTFGGGTKVEIK |

TABLE 6-continued

Humanized CD123 CAR Sequences

| Name | SEQ ID | Sequence |
|---|---|---|
| hzCAR123-9 NT | 74 | ATGGCCCTCCCTGTCACCGCCCTGCTGCTTCCGCTGGCTCTTCTGCTCCACGCCGCTCGGC<br>CCCAAGTGCAGCTGGTGCAGTCAGGCAGCGAACTGAAGAAGCCCGGAGCCTCCGTCAAAGT<br>GTCCTGCAAAGCCTCGGGATACACCTTCACCTCCTACTGGATGAACTGGGTCCGCCAGGCA<br>CCTGGACAGGGGCTGGAGTGGATGGGAAGGATCGATCCCTACGATTCCGAAACCCATTACA<br>ATCAGAAGTTCAAGGACCGGTTTGTGTTCTCCGTGGACAAGTCCGTGTCCACCGCCTACCT<br>CCAAATTAGCAGCCTGAAGGCGGAGGATACAGCTGTCTACTACTGCGCTCGCGGAAACTGG<br>GATGACTATTGGGGCCAGGGAACTACCGTGACTGTGTCCTCCGGGGGTGGCGGTAGCGGAG<br>GAGGGGGCTCCGGCGGCGGCGGCTCAGGGGGCGGAGGAAGCGACGTGCAGCTCACCCAGTC<br>GCCCTCATTTCTGTCGGCCTCAGTGGGAGACAGAGTGACCATTACTTGTCGGGCCTCCAAG<br>AGCATCTCCAAGGACCTGGCCTGGTATCAGCAGAAGCCAGGAAAGGCGCCTAAGTTGCTCA<br>TCTACTCGGGGTCGACCCTGCAATCTGGCGTGCCGTCCCGGTTCTCCGGTTCGGAAGCGG<br>TACCGAATTCACCCTTACTATCTCCTCCCTGCAACCGGAGACTTCGCCACCTACTACTGC<br>CAACAGCACAACAAGTACCCGTACACTTTCGGGGGTGGCACGAAGGTCGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggccctctggctggtacttgcggggtcctgctgctttcac<br>tcgtgatcactcttatactgtaagcgcggtcggaagaagctgctgtatacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-9 AA | 133 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-9 scFv | 192 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIK |
| hzCAR123-9 VH | 251 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-10 VL | 310 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-10 NT | 75 | ATGGCCCTCCCTGTCACCGCCCTGCTGCTTCCGCTGGCTCTTCTGCTCCACGCCGCTCGGC<br>CCCAAGTGCAGCTGGTGCAGTCAGGCAGCGAACTGAAGAAGCCCGGAGCCTCCGTCAAAGT<br>GTCCTGCAAAGCCTCGGGATACACCTTCACCTCCTACTGGATGAACTGGGTCCGCCAGGCA<br>CCTGGACAGGGGCTGGAGTGGATGGGAAGGATCGATCCCTACGATTCCGAAACCCATTACA<br>ATCAGAAGTTCAAGGACCGGTTTGTGTTCTCCGTGGACAAGTCCGTGTCCACCGCCTACCT<br>CCAAATTAGCAGCCTGAAGGCGGAGGATACAGCTGTCTACTACTGCGCTCGCGGAAACTGG<br>GATGACTATTGGGGCCAGGGAACTACCGTGACTGTGTCCTCCGGGGGTGGCGGTAGCGGAG<br>GAGGGGGCTCCGGCGGCGGCGGCTCAGGGGGCGGAGGAAGCGAAGTGGTGCTGACCCAGTC<br>GCCCGCAACCCTCTCTCTGTCGCCGGGAGAACGCGCCACTCTTTCCTGTCGGCGTCCAAG<br>AGCATCTCAAAGGACCTCGCCTGGTACCAGCAGAAGCCTGGTCAAGCCCCGCGGCTGCTGA<br>TCTACTCCGGCTCCACGCTGCAATCAGGAATCCCAGCCAGATTTTCCGGTTCGGGCTCGGG<br>GACTGACTTCACCTTGACCATTAGCTCGCTGGAACCTGAGGACTTCGCCGTGTATTACTGC<br>CAGCAGCACAACAAGTACCCGTACACCTTCGGAGGCGGTACTAAGGTCGAGATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggccctctggctggtacttgcggggtcctgctgctttcac<br>tcgtgatcactcttatactgtaagcgcggtcggaagaagctgctgtatacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-10 AA | 134 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSEVVLTQSPATLSLSPGERATLSCR |

TABLE 6-continued

Humanized CD123 CAR Sequences

| Name | SEQ ID | Sequence |
|---|---|---|
| | | ASKSISKDLAWYQQKPGQAPRLLIYSGSTLQSGIPARFSGSGSGTDFTLTISSLEPEDFA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>10<br>scFv | 193 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIK |
| hzCAR123-<br>10 VH | 252 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-<br>10 VL | 311 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-<br>11 NT | 76 | ATGGCCCTCCCTGTCACCGCCCTGCTGCTTCCGCTGGCTCTTCTGCTCCACGCCGCTCGGC<br>CCCAAGTGCAGCTGGTGCAGTCAGGCAGCGAACTGAAGAAGCCCGGAGCCTCCGTCAAAGT<br>GTCCTGCAAAGCCTCGGGATACACCTTCACCTCCTACTGGATGAACTGGGTCCGCCAGGCA<br>CCTGGACAGGGGCTGGAGTGGATGGGAAGGATCGATCCCTACGATTCCGAAACCCATTACA<br>ATCAGAAGTTCAAGGACCGGTTTGTGTTCTCCGTGGACAAGTCCGTGTCCACCGCCTACCT<br>CCAAATTAGCAGCCTGAAGGCGGAGGATACAGCTGTCTACTACTGCGCTCGCGGAAACTGG<br>GATGACTATTGGGGCCAGGGAACTACCGTGACTGTGTCCTCCGGGGGTGGCGGTAGCGGAG<br>GAGGGGGCTCCGGCGGCGGCGGCTCAGGGGGCGGAGGAAGCGACGTCGTGATGACCCAGTC<br>ACCGGCATTCCTGTCCGTGACTCCCGGAGAAAAGGTCACGATTACTTGCCGGGCGTCCAAG<br>AGCATCTCCAAGGACCTCGCCTGGTACCAACAGAAGCCGGACCAGGCCCCTAAGCTGTTGA<br>TCTACTCGGGGTCCACCCTTCAATCGGGAGTGCCATCGCGGTTTAGCGGTTCGGGTTCTGG<br>GACCGACTTCACTTTCACCATCTCCTCACTGGAAGCCGAGGATGCCGCCACTTACTACTGT<br>CAGCAGCACAACAAGTATCCGTACACCTTCGGAGGCGGTACCAAAGTGGAGATCAAGACCA<br>CTACCCCAGCACCGAGGCCACCCACCCCCGGCTCCTACCATGCCCTCCCAGCCTCTGTCCT<br>GCGTCCGGAggcatgtagacccgcagctggtggggccgtgcataccc gggtcttgactt c<br>gcctgcgatatctacatttgggcccctctggctggtacttgcggggtcctgctgctttcac<br>tcgtgatcactcttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |
| hzCAR123-<br>11 AA | 135 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>11<br>scFv | 194 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIK |
| hzCAR123-<br>11 VH | 253 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-<br>11 VL | 312 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-<br>12 NT | 77 | ATGGCCCTCCCTGTCACCGCCCTGCTGCTTCCGCTGGCTCTTCTGCTCCACGCCGCTCGGC<br>CCCAAGTGCAGCTGGTGCAGTCAGGCAGCGAACTGAAGAAGCCCGGAGCCTCCGTCAAAGT<br>GTCCTGCAAAGCCTCGGGATACACCTTCACCTCCTACTGGATGAACTGGGTCCGCCAGGCA<br>CCTGGACAGGGGCTGGAGTGGATGGGAAGGATCGATCCCTACGATTCCGAAACCCATTACA<br>ATCAGAAGTTCAAGGACCGGTTTGTGTTCTCCGTGGACAAGTCCGTGTCCACCGCCTACCT<br>CCAAATTAGCAGCCTGAAGGCGGAGGATACAGCTGTCTACTACTGCGCTCGCGGAAACTGG<br>GATGACTATTGGGGCCAGGGAACTACCGTGACTGTGTCCTCCGGGGGTGGCGGTAGCGGAG<br>GAGGGGGCTCCGGCGGCGGCGGCTCAGGGGGCGGAGGAAGCGACGTGGTCATGACTCAGTC<br>CCCGGACTCACTCGCGGTGTCGCTTGGAGAGAGAGCGACCATCAACTGTCGGGCCTCAAAG |

TABLE 6-continued

Humanized CD123 CAR Sequences

| Name | SEQ ID | Sequence |
|---|---|---|
| | | AGCATCAGCAAGGACCTGGCCTGGTACCAGCAGAAGCCGGGACAGCCGCCAAAGCTGCTGA |
| | | TCTACTCCGGGTCCACCTTGCAATCTGGTGTCCCTGACCGGTTCTCCGGTTCCGGGTCGGG |
| | | TACCGACTTCACGCTCACTATTTCGTCGCTGCAAGCCGAAGATGTGGCCGTGTACTATTGC |
| | | CAACAGCACAACAAGTACCCCTACACTTTTGGCGGAGGCACCAAGGTGGAAATCAAGACCA |
| | | CTACCCCAGCACCGAGGCCACCCACCCCGGCTCCTACCATCGCCTCCCAGCCTCTGTCCCT |
| | | GCGTCCGGAggcatgtagacccgcagctggtggggccgtgcatacccggggtcttgacttc |
| | | gcctgcgatatctacatttgggcccctctggctggtacttgcggggtcctgctgctttcac |
| | | tcgtgatcactcttttactgtaagcgcggtcggaagaagctgctgtacatctttaagcaacc |
| | | cttcatgaggcctgtgcagactactcaagaggaggacggctgttcatgccggttcccagag |
| | | gaggaggaaggcggctgcgaactgcgcgtgaaattcagccgcagcgcagatgctccagcct |
| | | acaagcaggggcagaaccagctctacaacgaactcaatcttggtcggagagaggagtacga |
| | | cgtgctggacaagcggagaggacgggacccagaaatgggcgggaagccgcgcagaaagaat |
| | | ccccaagagggcctgtacaacgagctccaaaaggataagatggcagaagcctatagcgaga |
| | | ttggtatgaaaggggaacgcagaagaggcaaaggccacgacggactgtaccagggactcag |
| | | caccgccaccaaggacacctatgacgctcttcacatgcaggccctgccgcctcgg |
| hzCAR123-12 AA | 136 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-12 scFv | 195 | MALPVTALLLPLALLLHAARPQVQLVQSGSELKKPGASVKVSCKASGYTFTSYWMNWVRQ<br>APGQGLEWMGRIDPYDSETHYNQKFKDRFVFSVDKSVSTAYLQISSLKAEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIK |
| hzCAR123-12 VH | 254 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-12 VL | 313 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |
| hzCAR123-13 NT | 78 | ATGGCCCTCCCTGTCACCGCCCTGCTGCTTCGCTGGCTCTTCTGCTCCACGCCGCTCGGC<br>CCGACGTGCAGCTCACCCAGTCGCCCTCATTTCTGTCGGCCTCAGTGGGAGACAGAGTGAC<br>CATTACTTGTCGGGCCTCCAAGAGCATCTCCAAGGACTTGGCCTGGTATCAGCAGAAGCCA<br>GGAAAGGCGCCTAAGTTGCTCATCTACTCGGGGTCGACCCTGCAATCTGGCGTGCCGTCCC<br>GGTTCTCCGGTTCGGGAAGCGGTACCGAATTCACCCTTACTATCTCCTCCCTGCAACCGGA<br>GGACTTCGCCACCTACTACTGCCAACAGCACAACAAGTACCCCGTACACTTTCGGGGTGGC<br>ACGAAGGTCGAAATCAAGGGGGGTGGCGGTAGCGGAGGAGGGGGCTCCGGCGGCGGCGGCT<br>CAGGGGGCGGAGGAAGCCAAGTGCAGCTGGTGCAGTCAGGCAGCGAACTGAAGAAGCCCGG<br>AGCCTCCGTCAAAGTGTCCTGCAAAGCCTCGGGATACACCTTCACCTCCTACTGGATGAAC<br>TGGGTCCGCCAGGCACCTGGACAGGGGCTGGAGTGGATGGGAAGGATCGATCCCTACGATT<br>CCGAAACCCATTACAATCAGAAGTTCAAGGACCGGTTTGTGTTCTCCGTGGACAAGTCCGT<br>GTCCACCGCCTACCTCCAAATTAGCAGCCTGAAGGCGGAGGATACAGCTGTCTACTACTGC<br>GCTCGCGGAAACTGGGATGACTATTGGGCCAGGGAACTACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-13 AA | 137 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-13 | 196 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG |

TABLE 6-continued

Humanized CD123 CAR Sequences

| Name | SEQ ID | Sequence |
|---|---|---|
| scFv | | GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-13 VH | 255 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-13 VL | 314 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-14 NT | 79 | ATGGCCCTCCCTGTCACCGCCCTGCTGCTTCCGCTGGCTCTTCTGCTCCACGCCGCTCGGC<br>CCGAAGTGGTGCTGACCCAGTCGCCCGCCAACCCTCTCTCTGTCGCCGGGAGAACGCGCCAC<br>TCTTTCCTGTCGGGCGTCCAAGAGCATCTCAAAGGACCTCGCCTGGTACCAGCAGAAGCCT<br>GGTCAAGCCCCGCGGCTGCTGATCTACTCCGGCTCCACGCTGCAATCAGGAATCCCAGCCA<br>GATTTTCCGGTTCGGGGTCGGGGACTGACTTCACCTTGACCATTAGCTCGCTGGAACCTGA<br>GGACTTCGCCGTGTATTACTGCCAGCAGCACAACAAGTACCCGTACACCTTCGGAGGCGGT<br>ACTAAGGTCGAGATCAAGGGGGGTGGCGGTAGCGGAGGAGGGGGCTCCGGCGGCGGCGGCT<br>CAGGGGGCGGAGGAAGCCAAGTGCAGCTGGTGCAGTCAGGCAGCGAACTGAAGAAGCCCGG<br>AGCCTCCGTCAAAGTGTCCTGCAAAGCCTCGGATACACCTTCACCTCCTACTGGATGAAC<br>TGGGTCCGCCAGGCACCTGGACAGGGGCTGGAGTGGATGGGAAGGATCGATCCCTACGATT<br>CCGAAACCCATTACAATCAGAAGTTCAAGGACCGGTTTGTGTTCTCCGTGGACAAGTCCGT<br>GTCCACCGCCTACCTCCAAATTAGCAGCCTGAAGGCGGAGGATACAGCTGTCTACTACTGC<br>GCTCGCGGAAACTGGGATGACTATTGGGGCCAGGGAACTACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgcggactgtaccagggactcag<br>caccgccaccaaggacacctatgacgctcttcacatgcaggcccctgccgcctcgg |
| hzCAR123-14 AA | 138 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-14 scFv | 197 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-14 VH | 256 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-14 VL | 315 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-15 NT | 80 | ATGGCCCTCCCTGTCACCGCCCTGCTGCTTCCGCTGGCTCTTCTGCTCCACGCCGCTCGGC<br>CCGACGTCGTGATGACCCAGTCACCGGCATTCCTGTCCGTGACTCCCGGAGAAAAGGTCAC<br>GATTACTTGCCGGGCGTCCAAGAGCATCTCCAAGGACCTCGCCTGGTACCAACAGAAGCCG<br>GACCAGGCCCCTAAGCTGTTGATCTACTCGGGGTCCACCCTTCAATCGGGAGTGCCATCGC<br>GGTTTAGCGGTTCGGGTTCTGGGACCGACTTCACTTTCACCATCTCCTCACTGGAAGCCGA<br>GGATGCCGCCACTTACTACTGTCAGCAGCACAACAAGTATCCGTACACCTTCGGAGGCGGT<br>ACCAAAGTGGAGATCAAGGGGGGTGGCGGTAGCGGAGGAGGGGGCTCCGGCGGCGGCGGCT<br>CAGGGGGCGGAGGAAGCCAAGTGCAGCTGGTGCAGTCAGGCAGCGAACTGAAGAAGCCCGG<br>AGCCTCCGTCAAAGTGTCCTGCAAAGCCTCGGATACACCTTCACCTCCTACTGGATGAAC<br>TGGGTCCGCCAGGCACCTGGACAGGGGCTGGAGTGGATGGGAAGGATCGATCCCTACGATT<br>CCGAAACCCATTACAATCAGAAGTTCAAGGACCGGTTTGTGTTCTCCGTGGACAAGTCCGT<br>GTCCACCGCCTACCTCCAAATTAGCAGCCTGAAGGCGGAGGATACAGCTGTCTACTACTGC<br>GCTCGCGGAAACTGGGATGACTATTGGGGCCAGGGAACTACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttactgtaagcgcggtcggaagaagctgctgtacatctttaagcaacc<br>cttcatgaggcctgtgcagactactcaagaggaggacggctgttcatgccggttcccagag |

TABLE 6-continued

Humanized CD123 CAR Sequences

| Name | SEQ ID | Sequence |
|---|---|---|
| | | gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |
| hzCAR123-<br>15 AA | 139 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>15<br>scFv | 198 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-<br>15 VH | 257 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-<br>15 VL | 316 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-<br>16 NT | 81 | ATGGCCCTCCCTGTCACCGCCCTGCTGCTTCCGCTGGCTCTTCTGCTCCACGCCGCTCGGC<br>CCGACGTGGTCATGACTCAGTCCCCGGACTCACTCGCGGTGTCGCTTGGAGAGAGAGCGAC<br>CATCAACTGTCGGGCCTCAAAGAGCATCAGCAAGGACCTGGCCTGGTACCAGCAGAAGCCG<br>GGACAGCCGCCAAAGCTGCTGATCTACTCCGGGTCCACCTTGCAATCTGGTGTCCCTGACC<br>GGTTCTCCGGTTCCGGGTCGGGTACCGACTTCACGCTCACTATTTCGTCGCTGCAAGCCGA<br>AGATGTGGCCGTGTACTATTGCCAACAGCACAACAAGTACCCCTACACTTTTGGCGGAGGC<br>ACCAAGGTGGAAATCAAGGGGGTGGCGGTAGCGGAGGAGGGGGCTCCGGCGGCGGCGGCT<br>CAGGGGGCGGAGGAAGCCAAGTGCAGCTGGTGCAGTCAGGCAGCGAACTGAAGAAGCCGG<br>AGCCTCCGTCAAAGTGTCCTGCAAAGCCTCGGGATACACCTTCACCTCCTACTGGATGAAC<br>TGGGTCCGCCAGGCACCTGGACAGGGGCTGGAGTGGATGGGAAGGATCGATCCCTACGATT<br>CCGAAACCCATTACAATCAGAAGTTCAAGGACCGGTTTGTGTTCTCCGTGGACAAGTCCGT<br>GTCCACCGCCTACCTCCAAATTAGCAGCCTGAAGGCGGAGGATACAGCTGTCTACTACTGC<br>GCTCGCGGAAACTGGGATGACTATTGGGGCCAGGGAACTACCGTGACTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccgggggtcttgacttc<br>gcctgcgatatctacatttgggccccctctggctggtacttgcgggggtcctgctgctttcac<br>tcgtgatcactcttttactgtaagcgcggtcggaagaagctgctgtacatcttttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |
| hzCAR123-<br>16 AA | 140 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>16<br>scFv | 199 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSQVQLVQSGSELKKPGASVKVSCKASGYTFTSY<br>WMNWVRQAPGQGLEWMGRIDPYDSETHYNQKFKDRFVFSVDKSVSTAYLQISSLKAEDTA<br>VYYCARGNWDDYWGQGTTVTVSS |
| hzCAR123-<br>16 VH | 258 | QVQLVQSGSELKKPGASVKVSCKASGYTFTSYWMNWVRQAPGQGLEWMGRIDPYDSETHYN<br>QKFKDRFVFSVDKSVSTAYLQISSLKAEDTAVYYCARGNWDDYWGQGTTVTVSS |
| hzCAR123-<br>16 VL | 317 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |

TABLE 6-continued

Humanized CD123 CAR Sequences

| Name | SEQ ID | Sequence |
|---|---|---|
| hzCAR123-17 NT | 82 | ATGGCCCTCCCTGTCACCGCCCTGCTGCTTCCGCTGGCTCTTCTGCTCCACGCCGCTCGGC<br>CCGAGGTGCAGCTGGTGCAGAGCGGAGCCGAGGTCAAGAAGCCTGGAGAATCCCTGAGGAT<br>CAGCTGCAAAGGCAGCGGGTATACCTTCACCTCCTACTGGATGAATTGGGTCCGCCAGATG<br>CCCGGAAAAGGCCTGGAGTGGATGGGACGGATTGACCCCTACGACTCGGAAACCCATTACA<br>ACCAGAAGTTCAAGGATCACGTGACCATCTCCGTGGACAAGTCCATTTCCACTGCGTACCT<br>CCAGTGGTCAAGCCTGAAGGCCTCCGACACTGCTATGTACTACTGCGCACGCGGAAACTGG<br>GATGATTACTGGGGACAGGGAACAACCGTGACTGTGTCCTCCGGGGGTGGCGGTAGCGGAG<br>GAGGGGGCTCCGGCGGCGGCGGCTCAGGGGGCGGAGGAAGCGACGTGCAGCTCACCCAGTC<br>GCCCTCATTTCTGTCGGCCTCAGTGGGAGACAGAGTGACCATTACTTGTCGGGCCTCCAAG<br>AGCATCTCCAAGGACCTGGCCTGGTATCAGCAGAAGCCAGGAAAGGCGCCTAAGTTGCTCA<br>TCTACTCGGGGTCGACCCTGCAATCTGGCGTGCCGTCCCGGTTCTCCGGTTCGGGAAGCGG<br>TACCGAATTCACCCTTACTATCTCCTCCCTGCAACCGGAGGACTTCGCCACCTACTACTGC<br>CAACAGCACAACAAGTACCCGTACACTTTCGGGGGTGGCACGAAGGTCGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-17 AA | 141 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-17 scFv | 200 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIK |
| hzCAR123-17 VH | 259 | EVQLVQSGAEVKKPGESLRISCKGSGYTFTSYWMNWVRQMPGKGLEWMGRIDPYDSETHYN<br>QKFKDHVTISVDKSISTAYLQWS SLKASDTAMYYCARGNWDDYWGQGTTVTVSS |
| hzCAR123-17 VL | 318 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-18 NT | 83 | ATGGCCCTCCCTGTCACCGCCCTGCTGCTTCCGCTGGCTCTTCTGCTCCACGCCGCTCGGC<br>CCGAGGTGCAGCTGGTGCAGAGCGGAGCCGAGGTCAAGAAGCCTGGAGAATCCCTGAGGAT<br>CAGCTGCAAAGGCAGCGGGTATACCTTCACCTCCTACTGGATGAATTGGGTCCGCCAGATG<br>CCCGGAAAAGGCCTGGAGTGGATGGGACGGATTGACCCCTACGACTCGGAAACCCATTACA<br>ACCAGAAGTTCAAGGATCACGTGACCATCTCCGTGGACAAGTCCATTTCCACTGCGTACCT<br>CCAGTGGTCAAGCCTGAAGGCCTCCGACACTGCTATGTACTACTGCGCACGCGGAAACTGG<br>GATGATTACTGGGGACAGGGAACAACCGTGACTGTGTCCTCCGGGGGTGGCGGTAGCGGAG<br>GAGGGGGCTCCGGCGGCGGCGGCTCAGGGGGCGGAGGAAGCGAAGTGGTGCTGACCCAGTC<br>GCCCGCAACCCTCTCTCTGTCGCCGGGAGAACGCGCCACTCTTTCCTGTCGGCGTCCAAG<br>AGCATCTCAAAGGACCTCGCCTGGTACCAGCAGAAGCCTGGTCAAGCCCCGCGGCTGCTGA<br>TCTACTCCGGCTCCACGCTGCAATCAGGAATCCCAGCCAGATTTTCCGGTTCGGGGTCGGG<br>GACTGACTTCACCTTGACCATTAGCTCGCTGGAACCTGAGGACTTCGCCGTGTATTACTGC<br>CAGCAGCACAACAAGTACCCGTACACCTTCGGAGGCGGTACTAAGGTCGAGATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-18 AA | 142 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG |

TABLE 6-continued

Humanized CD123 CAR Sequences

| Name | SEQ ID | Sequence |
|---|---|---|
| | | NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>18<br>scFv | 201 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSEVVLTQSPATLSLSPGERATLSCR<br>ASKSISKDLAWYQQKPGQAPRLLIYSGSTLQSGIPARFSGSGSGTDFTLTISSLEPEDFA<br>VYYCQQHNKYPYTFGGGTKVEIK |
| hzCAR123-<br>18 VH | 260 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-<br>18 VL | 319 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-<br>19 NT | 84 | ATGGCCCTCCCTGTCACCGCCCTGCTGCTTCCGCTGGCTCTTCTGCTCCACGCCGCTCGGC<br>CCGAGGTGCAGCTGGTGCAGAGCGGAGCCGAGGTCAAGAAGCCTGGAGAATCCCTGAGGAT<br>CAGCTGCAAAGGCAGCGGGTATACCTTCACCTCCTACTGGATGAATTGGGTCCGCCAGATG<br>CCCGGAAAAGGCCTGGAGTGGATGGGACGGATTGACCCCTACGACTCGGAAACCCATTACA<br>ACCAGAAGTTCAAGGATCACGTGACCATCTCCGTGGACAAGTCCATTTCCACTGCGTACCT<br>CCAGTGGTCAAGCCTGAAGGCCTCCGACACTGCTATGTACTACTGCGCACGCGGAAACTGG<br>GATGATTACTGGGGACAGGGAACAACCGTGACTGTGTCCTCCGGGGGTGGCGGTAGCGGAG<br>GAGGGGGCTCCGGCGGCGGCGGCTCAGGGGGCGGAGGAAGCGACGTCGTGATGACCCAGTC<br>ACCGGCATTCCTGTCCGTGACTCCCGGAGAAAAGGTCACGATTACTTGCCGGGCGTCCAAG<br>AGCATCTCCAAGGACCTCGCCTGGTACCAACAGAAGCCGGACCAGGCCCCTAAGCTGTTGA<br>TCTACTCGGGGTCCACCCTTCAATCGGGAGTGCCATCGCGGTTTAGCGGTTCGGGTTCTGG<br>GACCGACTTCACTTTCACCATCTCCTCACTGGAAGCCGAGGATGCCGCCACTTACTACTGT<br>CAGCAGCACAACAAGTATCCGTACACCTTCGGAGGCGGTACCAAAGTGGAGATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcataccggggtcttgacttc<br>gcctgcgatatctacatttgggcccctctggctggtacttgcggggtcctgctgctttcac<br>tcgtgatcactcttactgtaagcgcggtcggaagaagctgctgtacatctcttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggaccccagaaatgggcgggaagcgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-<br>19 AA | 143 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>19<br>scFv | 202 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVVMTQSPAFLSVTPGEKVTITCR<br>ASKSISKDLAWYQQKPDQAPKLLIYSGSTLQSGVPSRFSGSGSGTDFTFTISSLEAEDAA<br>TYYCQQHNKYPYTFGGGTKVEIK |
| hzCAR123-<br>19 VH | 261 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-<br>19 VL | 320 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-<br>20 NT | 85 | ATGGCCCTCCCTGTCACCGCCCTGCTGCTTCCGCTGGCTCTTCTGCTCCACGCCGCTCGGC<br>CCGAGGTGCAGCTGGTGCAGAGCGGAGCCGAGGTCAAGAAGCCTGGAGAATCCCTGAGGAT<br>CAGCTGCAAAGGCAGCGGGTATACCTTCACCTCCTACTGGATGAATTGGGTCCGCCAGATG<br>CCCGGAAAAGGCCTGGAGTGGATGGGACGGATTGACCCCTACGACTCGGAAACCCATTACA<br>ACCAGAAGTTCAAGGATCACGTGACCATCTCCGTGGACAAGTCCATTTCCACTGCGTACCT<br>CCAGTGGTCAAGCCTGAAGGCCTCCGACACTGCTATGTACTACTGCGCACGCGGAAACTGG<br>GATGATTACTGGGGACAGGGAACAACCGTGACTGTGTCCTCCGGGGGTGGCGGTAGCGGAG<br>GAGGGGGCTCCGGCGGCGGCGGCTCAGGGGGCGGAGGAAGCGACGTGGTCATGACTCAGTC |

TABLE 6-continued

Humanized CD123 CAR Sequences

| Name | SEQ ID | Sequence |
|---|---|---|
| | | CCCGGACTCACTCGCGGTGTCGCTTGGAGAGAGAGCGACCATCAACTGTCGGGCCTCAAAG<br>AGCATCAGCAAGGACCTGGCCTGGTACCAGCAGAAGCCGGGACAGCCGCCAAAGCTGCTGA<br>TCTACTCCGGGTCCACCTTGCAATCTGGTGTCCCTGACCGGTTCTCCGGTTCCGGGTCGGG<br>TACCGACTTCACGCTCACTATTTCGTCGCTGCAAGCCGAAGATGTGGCCGTGTACTATTGC<br>CAACAGCACAACAAGTACCCCTACACTTTTGGCGGAGGCACCAAGGTGGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-<br>20 AA | 144 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-<br>20<br>scFv | 203 | MALPVTALLLPLALLLHAARPEVQLVQSGAEVKKPGESLRISCKGSGYTFTSYWMNWVRQ<br>MPGKGLEWMGRIDPYDSETHYNQKFKDHVTISVDKSISTAYLQWSSLKASDTAMYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIK |
| hzCAR123-<br>20 VH | 262 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-<br>20 VL | 321 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |
| hzCAR123-<br>21 NT | 86 | ATGGCCCTCCCTGTCACCGCCCTGCTGCTTCCGCTGGCTCTTCTGCTCCACGCCGCTCGGC<br>CCGACGTGCAGCTCACCCAGTCGCCCTCATTTCTGTCGGCCTCAGTGGAGACAGAGTGAC<br>CATTACTTGTCGGGCCTCCAAGAGCATCTCCAAGGACCTGGCCTGGTATCAGCAGAAGCCA<br>GGAAAGGCGCCTAAGTTGCTCATCTACTCGGGGTCGACCCTGCAATCTGGCGTGCCGTCCC<br>GGTTCTCCGGTTCGGGAAGCGGTACCGAATTCACCCTTACTATCTCCTCCCTGCAACCGGA<br>GGACTTCGCCACCTACTACTGCCAACAGCACAACAAGTACCCGTACACTTTTCGGGGGTGGC<br>ACGAAGGTCGAAATCAAGGGGGTGGCGGTAGCGGAGGAGGGGGCTCCGGCGGCGGCGGCT<br>CAGGGGGCGGAGGAAGCGAGGTGCAGCTGGTGCAGAGCGGAGCCGAGGTCAAGAAGCCTGG<br>AGAATCCCTGAGGATCAGCTGCAAAGGCAGCGGGTATACCTTCACCTCCTACTGGATGAAT<br>TGGGTCCGCAGATGCCCGGAAAAGGCCTGGAGTGGATGGACGGATTGACCCCTACGACT<br>CGGAAACCCATTACAACCAGAAGTTCAAGGATCACGTGACCATCTCCGTGGACAAGTCCAT<br>TTCCACTGCGTACCTCCAGTGGTCAAGCCTGAAGGCCTCCGACACTGCTATGTACTACTGC<br>GCACGCGGAAACTGGGATGATTACTGGGGACAGGGAACAACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-<br>21 AA | 145 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |

TABLE 6-continued

Humanized CD123 CAR Sequences

| Name | SEQ ID | Sequence |
|---|---|---|
| hzCAR123-21 scFv | 204 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTSS |
| hzCAR123-21 VH | 263 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-21 VL | 322 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-22 NT | 87 | ATGGCCCTCCCTGTCACCGCCCTGCTGCTTCCGCTGGCTCTTCTGCTCCACGCCGCTCGGC<br>CCGAAGTGGTGCTGACCCAGTCGCCCGCAACCCTCTCTCTGTCGCCGGGAGAACGCGCCAC<br>TCTTTCCTGTCGGGCGTCCAAGAGCATCTCAAAGGACCTCGCCTGGTACCAGCAGAAGCCT<br>GGTCAAGCCCCGCGGCTGCTGATCTACTCCGGCTCCACGCTGCAATCAGGAATCCCAGCCA<br>GATTTTCCGGTTCGGGGTCGGGGACTGACTTCACCTTGACCATTAGCTCGCTGGAACCTGA<br>GGACTTCGCCGTGTATTACTGCCAGCAGCACAACAAGTACCCGTACACCTTCGGAGGCGGT<br>ACTAAGGTCGAGATCAAGGGGGGTGGCGGTAGCGGAGGAGGGGGCTCCGGCGGCGGCGGCT<br>CAGGGGGCGGAGGAAGCGAGGTGCAGCTGGTGCAGAGCGGAGCCGAGGTCAAGAAGCCTGG<br>AGAATCCCTGAGGATCAGCTGCAAAGGCAGCGGGTATACCTTCACCTCCTACTGGATGAAT<br>TGGGTCCGCCAGATGCCCGGAAAAGGCCTGGAGTGGATGGGACGGATTGACCCCTACGACT<br>CGGAAACCCATTACAACCAGAAGTTCAAGGATCACGTGACCATCTCCGTGGACAAGTCCAT<br>TTCCACTGCGTACCTCCAGTGGTCAAGCCTGAAGGCCTCCGACACTGCTATGTACTACTGC<br>GCACGCGGAAACTGGGATGATTACTGGGGACAGGGAACAACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtgggccgtgcatacccggggtcttgacttc<br>gcctgcgatatctacatttgggcccctctggctggtacttgcggggtcctgctgctttcac<br>tcgtgatcacttttactgtaagcgcggtcggaagaagctgctgtacatcttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |
| hzCAR123-22 AA | 146 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-22 scFv | 205 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-22 VH | 264 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-22 VL | 323 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-23 NT | 88 | ATGGCCCTCCCTGTCACCGCCCTGCTGCTTCCGCTGGCTCTTCTGCTCCACGCCGCTCGGC<br>CCGACGTCGTGATGACCCAGTCACCGGCATTCCTGTCCGTGACTCCCGGAGAAAAGGTCAC<br>GATTACTTGCCGGGCGTCCAAGAGCATCTCCAAGGACCTCGCCTGGTACCAACAGAAGCCG<br>GACCAGGCCCCTAAGCTGTTGATCTACTCGGGGTCCACCCTTCAATCGGGAGTGCCATCGC<br>GGTTTAGCGGTTCGGGTTCTGGGACCGACTTCACTTTCACCATCTCCTCACTGGAAGCCGA<br>GGATGCCGCCACTTACTACTGTCAGCAGCACAACAAGTATCCGTACACCTTCGGAGGCGGT<br>ACCAAAGTGGAGATCAAGGGGGGTGGCGGTAGCGGAGGAGGGGGCTCCGGCGGCGGCGGCT<br>CAGGGGGCGGAGGAAGCGAGGTGCAGCTGGTGCAGAGCGGAGCCGAGGTCAAGAAGCCTGG<br>AGAATCCCTGAGGATCAGCTGCAAAGGCAGCGGGTATACCTTCACCTCCTACTGGATGAAT<br>TGGGTCCGCCAGATGCCCGGAAAAGGCCTGGAGTGGATGGGACGGATTGACCCCTACGACT<br>CGGAAACCCATTACAACCAGAAGTTCAAGGATCACGTGACCATCTCCGTGGACAAGTCCAT<br>TTCCACTGCGTACCTCCAGTGGTCAAGCCTGAAGGCCTCCGACACTGCTATGTACTACTGC<br>GCACGCGGAAACTGGGATGATTACTGGGGACAGGGAACAACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtgggccgtgcatacccggggtcttgacttc<br>gcctgcgatatctacatttgggcccctctggctggtacttgcggggtcctgctgctttcac |

TABLE 6-continued

Humanized CD123 CAR Sequences

| Name | SEQ ID | Sequence |
|---|---|---|
| | | tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-23 AA | 147 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-23 scFv | 206 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-23 VH | 265 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |
| hzCAR123-23 VL | 324 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-24 NT | 89 | ATGGCCCTCCCTGTCACCGCCCTGCTGCTTCCGCTGGCTCTTCTGCTCCACGCCGCTCGGC<br>CGACGTGGTCATGACTCAGTCCCCGGACTCACTCGCGGTGTCGCTTGGAGAGAGAGCGAC<br>CATCAACTGTCGGGCCTCAAAGAGCATCAGCAAGGACCTGGCCTGGTACCAGCAGAAGCCG<br>GGACAGCCGCCAAAGCTGCTGATCTACTCCGGGTCCACCTTGCAATCTGGTGTCCCTGACC<br>GGTTCTCCGGTTCCGGGTCGGGTACCGACTTCACGCTCACTATTTCGTCGCTGCAAGCCGA<br>AGATGTGGCCGTGTACTATTGCCAACAGCACAACAAGTACCCCTACACTTTTGGCGGAGGC<br>ACCAAGGTGGAAATCAAGGGGGGTGGCGGTAGCGGAGGAGGGGGCTCCGGCGGCGGCGGCT<br>CAGGGGGCGAGGAAGCGAGGTGCAGCTGGTGCAGAGCGGAGCCGAGGTCAAGAAGCCTGG<br>AGAATCCCTGAGGATCAGCTGCAAAGGCAGCGGGTATACCTTCACCTCCTACTGGATGAAT<br>TGGGTCCGCCAGATGCCCGGAAAAGGCCTGGAGTGGATGGACGGATTGACCCCTACGACT<br>CGGAAACCCATTACAACCAGAAGTTCAAGGATCACGTGACCATCTCCGTGGACAAGTCCAT<br>TTCCACTGCGTACCTCCAGTGGTCAAGCCTGAAGGCCTCCGACACTGCTATGTACTACTGC<br>GCACGCGGAAACTGGGATGATTACTGGGGACAGGGAACAACCGTGACTGTGTCCTCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcataccgggggtcttgacttc<br>gcctgcgatatctacatttgggcccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-24 AA | 148 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-24 scFv | 207 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVQSGAEVKKPGESLRISCKGSGYTFTSY<br>WMNWVRQMPGKGLEWMGRIDPYDSETHYNQKFKDHVTISVDKSISTAYLQWSSLKASDTA<br>MYYCARGNWDDYWGQGTTVTVSS |
| hzCAR123-24 VH | 266 | EVQLVQSGAEVKKPGESLRISCKGSGYTFTSYWMNWVRQMPGKGLEWMGRIDPYDSETHYN<br>QKFKDHVTISVDKSISTAYLQWSSLKASDTAMYYCARGNWDDYWGQGTTVTVSS |

TABLE 6-continued

Humanized CD123 CAR Sequences

| Name | SEQ ID | Sequence |
|---|---|---|
| hzCAR123-24 VL | 325 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |
| hzCAR123-25 NT | 90 | ATGGCCCTCCCTGTCACCGCCCTGCTGCTTCCGCTGGCTCTTCTGCTCCACGCCGCTCGGC<br>CCGAAGTGCAGCTCGTCGAGAGCGGAGGGGGACTGGTGCAGCCCGGAGGAAGCCTGAGGCT<br>GTCCTGCGCTGCCTCCGGCTACACCTTCACCTCCTACTGGATGAACTGGGTCAGACAGGCA<br>CCTGGAAAGGGACTGGTCTGGGTGTCGCGCATTGACCCCTACGACTCCGAAACCCATTACA<br>ATCAGAAATTCAAGGACCGCTTCACCATCTCCGTGGACAAAGCCAAGAGCACCGCGTACCT<br>CCAAATGAACTCCCTGCGCGCTGAGGATACAGCAGTGTACTATTGCGCCCGGGGAAACTGG<br>GATGATTACTGGGGCCAGGGAACTACTGTGACTGTGTCATCCGGGGGTGGCGGTAGCGGAG<br>GAGGGGGCTCCGGCGGCGGCGGCTCAGGGGGCGGAGGAAGCGACGTGCAGCTCACCCAGTC<br>GCCCTCATTTCTGTCGGCCTCAGTGGGAGACAGAGTGACCATTACTTGTCGGGCCTCCAAG<br>AGCATCTCCAAGGACCTGGCCTGGTATCAGCAGAAGCCAGGAAAGGCGCCTAAGTTGCTCA<br>TCTACTCGGGGTCGACCCTGCAATCTGGCGTGCCGTCCCGGTTCTCCGGTTCGGGAAGCGG<br>TACCGAATTCACCCTTACTATCTCCTCCCTGCAACCGGAGGACTTCGCCACCTACTACTGC<br>CAACAGCACAACAAGTACCCGTACACTTTCGGGGGTGGCACGAAGGTCGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtgggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |
| hzCAR123-25 AA | 149 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-25 scFv | 208 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVQLTQSPSFLSASVGDRVTITCR<br>ASKSISKDLAWYQQKPGKAPKLLIYSGSTLQSGVPSRFSGSGSGTEFTLTISSLQPEDFA<br>TYYCQQHNKYPYTFGGGTKVEIK |
| hzCAR123-25 VH | 267 | EVQLVESGGGLVQPGGSLRLSCAASGYTFTSYWMNWVRQAPGKGLVWVSRIDPYDSETHYN<br>QKFKDRFTISVDKAKSTAYLQMNSLRAEDTAVYYCARGNWDDYWGQGTTVTVSS |
| hzCAR123-25 VL | 326 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-26 NT | 91 | ATGGCCCTCCCTGTCACCGCCCTGCTGCTTCCGCTGGCTCTTCTGCTCCACGCCGCTCGGC<br>CCGAAGTGCAGCTCGTCGAGAGCGGAGGGGGACTGGTGCAGCCCGGAGGAAGCCTGAGGCT<br>GTCCTGCGCTGCCTCCGGCTACACCTTCACCTCCTACTGGATGAACTGGGTCAGACAGGCA<br>CCTGGAAAGGGACTGGTCTGGGTGTCGCGCATTGACCCCTACGACTCCGAAACCCATTACA<br>ATCAGAAATTCAAGGACCGCTTCACCATCTCCGTGGACAAAGCCAAGAGCACCGCGTACCT<br>CCAAATGAACTCCCTGCGCGCTGAGGATACAGCAGTGTACTATTGCGCCCGGGGAAACTGG<br>GATGATTACTGGGGCCAGGGAACTACTGTGACTGTGTCATCCGGGGGTGGCGGTAGCGGAG<br>GAGGGGGCTCCGGCGGCGGCGGCTCAGGGGGCGGAGGAAGCGAAGTGGTGCTGACCCAGTC<br>GCCCGCAACCCTCTCTCTGTCGCCGGGAGAACGCGCCACTCTTTCCTGTCGGGCGTCCAAG<br>AGCATCTCAAAGGACCTCGCCTGGTACCAGCAGAAGCCTGGTCAAGCCCGCGGCTGCTGA<br>TCTACTCCGGCTCCACGCTGCAATCAGGAATCCCAGCCAGATTTTCCGGTTCGGGTCGGG<br>GACTGACTTCACCTTGACCATTAGCTCGCTGGAACCTGAGGACTTCGCCGTGTATTACTGC<br>CAGCAGCACAACAAGTACCCGTACACCTTCGGAGGCGGTACTAAGGTCGAGATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtgggccgtgcatacccggggtcttgacttc<br>gcctgcgatatctacatttgggcccctctggctggtacttgcggggtcctgctgctttcac<br>tcgtgatcactcttttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggggaacgcagaagaggcaaaggccacgacggactgtaccagggactcag<br>caccgccaccaaggacacctatgacgctcttcacatgcaggccctgccgcctcgg |

TABLE 6-continued

Humanized CD123 CAR Sequences

| Name | SEQ ID | Sequence |
|---|---|---|
| hzCAR123-26 AA | 150 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDMKAEAYSEIGMKGERRRGKGHDGLYQGLSTATKDTYDALHM QALPPR |
| hzCAR123-26 scFv | 209 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTFGGGTKVEIK |
| hzCAR123-26 VH | 268 | EVQLVESGGGLVQPGGSLRLSCAASGYTFTSYWMNWVRQAPGKGLVWVSRIDPYDSETHYN QKFKDRFTISVDKAKSTAYLQMNSLRAEDTAVYYCARGNWDDYWGQGTTVTVSS |
| hzCAR123-26 VL | 327 | EVVLTQSPATLSLSPGERATLSCRASKSISKDLAWYQQKPGQAPRLLIYSGSTLQSGIPAR FSGSGSGTDFTLTISSLEPEDFAVYYCQQHNKYPYTFGGGTKVEIK |
| hzCAR123-27 NT | 92 | ATGGCCCTCCCTGTCACCGCCCTGCTGCTTCCGCTGGCTCTTCTGCTCCACGCCGCTCGGC CCGAAGTGCAGCTCGTCGAGAGCGGAGGGGGACTGGTGCAGCCCGGAGGAAGCCTGAGGCT GTCCTGCGCTGCCTCCGGCTACACCTTCACCTCCTACTGGATGAACTGGGTCAGACAGGCA CCTGGAAAGGGACTGGTCTGGGTGTCGCGCATTGACCCCTACGACTCCGAAACCCATTACA ATCAGAAATTCAAGGACCGCTTCACCATCTCCGTGGACAAAGCCAAGAGCACCGCGTACCT CCAAATGAACTCCCTGCGCGCTGAGGATACAGCAGTGTACTATTGCGCCCGGGGAAACTGG GATGATTACTGGGGCCAGGGAACTACTGTGACTGTGTCATCCGGGGGTGGCGGTAGCGGAG GAGGGGGCTCCGGCGGCGGCGGCTCAGGGGGCGGAGGAAGCGACGTCGTGATGACCCAGTC ACCGGCATTCCTGTCCGTGACTCCGGAGAAAAGGTCACGATTACTTGCCGGGCGTCCAAG AGCATCTCCAAGGACCTCGCCTGGTACCAACAGAAGCCGGACCAGGCCCCTAAGCTGTTGA TCTACTCGGGGTCCACCCTTCAATCGGGAGTGCCATCGCGGTTTAGCGGTTCGGGTTCTGG GACCGACTTCACTTTCACCATCTCCTCACTGGAAGCCGAGGATGCCGCCACTTACTACTGT CAGCAGCACAACAAGTATCCGTACACCTTCGGAGGCGGTACCAAAGTGGAGATCAAGACCA CTACCCCAGCACCGAGGCCACCCACCCCGGCTCCTACCATCGCCTCCCAGCCTCTGTCCCT GCGTCCGGAggcatgtagacccgcagctggtggggccgtgcataccgggtcttgacttc gcctgcgatatctacatttgggcccctctggctggtacttgcggggtcctgctgctttcac tcgtgatcactcttactgtaagcgcggtcggaagaagctgctgtacatctttaagcaacc cttcatgaggcctgtgcagactactcaagaggaggacggctgttcatgccggttcccagag gaggaggaaggcggctgcgaactgcgcgtgaaattcagccgcagcgcagatgctccagcct acaagcaggggcagaaccagctctacaacgaactcaatcttggtcggagagaggagtcga cgtgctggacaagcggagaggacgggacccagaaatgggcgggaagccgcgcagaaagaat ccccaagagggcctgtacaacgagctccaaaaggataagatggcagaagcctatagcgaga ttggtatgaaaggggaacgcagaagaggcaaaggccacgacggactgtaccagggactcag caccgccaccaaggacacctatgacgcgtcttcacatgcaggccctgccgcctcgg |
| hzCAR123-27 AA | 151 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDMKAEAYSEIGMKGERRRGKGHDGLYQGLSTATKDTYDALHM QALPPR |
| hzCAR123-27 scFv | 210 | MALPVTALLLPLALLLHAARPEVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIK |
| hzCAR123-27 VH | 269 | EVQLVESGGGLVQPGGSLRLSCAASGYTFTSYWMNWVRQAPGKGLVWVSRIDPYD SETHYN QKFKDRFTISVDKAKSTAYLQMNSLRAEDTAVYYCARGNWDDYWGQGTTVTVSS |
| hzCAR123-27 VL | 328 | DVVMTQSPAFLSVTPGEKVTITCRASKSISKDLAWYQQKPDQAPKLLIYSGSTLQSGVPSR FSGSGSGTDFTFTISSLEAEDAATYYCQQHNKYPYTFGGGTKVEIK |
| hzCAR123-28 NT | 93 | ATGGCCCTCCCTGTCACCGCCCTGCTGCTTCCGCTGGCTCTTCTGCTCCACGCCGCTCGGC CCGAAGTGCAGCTCGTCGAGAGCGGAGGGGGACTGGTGCAGCCCGGAGGAAGCCTGAGGCT GTCCTGCGCTGCCTCCGGCTACACCTTCACCTCCTACTGGATGAACTGGGTCAGACAGGCA CCTGGAAAGGGACTGGTCTGGGTGTCGCGCATTGACCCCTACGACTCCGAAACCCATTACA ATCAGAAATTCAAGGACCGCTTCACCATCTCCGTGGACAAAGCCAAGAGCACCGCGTACCT CCAAATGAACTCCCTGCGCGCTGAGGATACAGCAGTGTACTATTGCGCCCGGGGAAACTGG |

TABLE 6-continued

Humanized CD123 CAR Sequences

| Name | SEQ ID | Sequence |
|---|---|---|
| | | GATGATTACTGGGGCCAGGGAACTACTGTGACTGTGTCATCCGGGGTGGCGGTAGCGGAG<br>GAGGGGGCTCCGGCGGCGGCGGCTCAGGGGGCGGAGGAAGCGACGTGGTCATGACTCAGTC<br>CCCGGACTCACTCGCGGTGTCGCTTGGAGAGAGAGCGACCATCAACTGTCGGGCCTCAAAG<br>AGCATCAGCAAGGACCTGGCCTGGTACCAGCAGAAGCCGGGACAGCCGCCAAAGCTGCTGA<br>TCTACTCCGGGTCCACCTTGCAATCTGGTGTCCCTGACCGGTTCTCCGGTTCCGGGTCGGG<br>TACCGACTTCACGCTCACTATTTCGTCGCTGCAAGCCGAAGATGTGGCCGTGTACTATTGC<br>CAACAGCACAACAAGTACCCCTACACTTTTGGCGGAGGCACCAAGGTGGAAATCAAGACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttactgtaagcgcggtcggaagaagctgctgtacatcttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-28 AA | 152 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-28 scFv | 211 | MALPVTALLLPLALLLHAARPEVQLVESGGGLVQPGGSLRLSCAASGYTFTSYWMNWVRQ<br>APGKGLVWVSRIDPYDSETHYNQKFKDRFTISVDKAKSTAYLQMNSLRAEDTAVYYCARG<br>NWDDYWGQGTTVTVSSGGGGSGGGGSGGGGSGGGGSDVVMTQSPDSLAVSLGERATINCR<br>ASKSISKDLAWYQQKPGQPPKLLIYSGSTLQSGVPDRFSGSGSGTDFTLTISSLQAEDVA<br>VYYCQQHNKYPYTFGGGTKVEIK |
| hzCAR123-28 VH | 270 | EVQLVESGGGLVQPGGSLRLSCAASGYTFTSYWMNWVRQAPGKGLVWVSRIDPYD SETHYN<br>QKFKDRFTISVDKAKSTAYLQMNSLRAEDTAVYYCARGNWDDYWGQGTTVTVSS |
| hzCAR123-28 VL | 329 | DVVMTQSPDSLAVSLGERATINCRASKSISKDLAWYQQKPGQPPKLLIYSGSTLQSGVPDR<br>FSGSGSGTDFTLTISSLQAEDVAVYYCQQHNKYPYTFGGGTKVEIK |
| hzCAR123-29 NT | 94 | ATGGCCCTCCCTGTCACCGCCCTGCTGCTTCCGCTGGCTCTTCTGCTCCACGCCGCTCGGC<br>CCGACGTGCAGCTCACCCAGTCGCCCTCATTTCTGTCGGCCTCAGTGGGAGACAGAGTGAC<br>CATTACTTGTCGGGCCTCCAAGAGCATCTCCAAGGACCTGGCCTGGTATCAGCAGAAGCCA<br>GGAAAGGCGCCTAAGTTGCTCATCTACTCGGGGTCGACCCTGCAATCTGGCGTGCCGTCC<br>GGTTCTCCGGTTCGGGAAGCGGTACCGAATTCACCCTTACTATCTCCTCCCTGCAACCGGA<br>GGACTTCGCCACCTACTACTGCCAACAGCACAACAAGTACCCGTACACTTTCGGGGGTGGC<br>ACGAAGGTCGAAATCAAGGGGGGTGGCGGTAGCGGAGGAGGGGGCTCCGGCGGCGGCGGCT<br>CAGGGGGCGGAGGAAGCGAAGTGCAGCTCGTCGAGAGCGGAGGGGGACTGGTGCAGCCCGG<br>AGGAAGCCTGAGGCTGTCCTGCGCTGCCTCCGGCTACACCTTCACCTCCTACTGGATGAAC<br>TGGGTCAGACAGGCACCTGGAAAGGGACTGGTCTGGGTGTCGCGCATTGACCCCTACGACT<br>CCGAAACCCATTACAATCAGAAATTCAAGGACCGCTTCACCATCTCCGTGGACAAAGCCAA<br>GAGCACCGCGTACCTCCAAATGAACTCCCTGCGCGCTGAGGATACAGCAGTGTACTATTGC<br>GCCCGGGGAAACTGGGATGATTACTGGGGCCAGGGAACTACTGTGACTGTGTCATCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctacatttgggcccctctggctggtacttgcggggtcctgctgctttcac<br>tcgtgatcactcttactgtaagcgcggtcggaagaagctgctgtacatcttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-29 AA | 153 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |

TABLE 6-continued

Humanized CD123 CAR Sequences

| Name | SEQ ID | Sequence |
|---|---|---|
| hzCAR123-29 scFv | 212 | MALPVTALLLPLALLLHAARPDVQLTQSPSFLSASVGDRVTITCRASKSISKDLAWYQQK<br>PGKAPKLLIYSGSTLQSGVPSRFSGSGSGTEFTLTISSLQPEDFATYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-29 VH | 271 | EVQLVESGGGLVQPGGSLRLSCAASGYTFTSYWMNWVRQAPGKGLVWVSRIDPYDSETHYN<br>QKFKDRFTISVDKAKSTAYLQMNSLRAEDTAVYYCARGNWDDYWGQGTTVTVSS |
| hzCAR123-29 VL | 330 | DVQLTQSPSFLSASVGDRVTITCRASKSISKDLAWYQQKPGKAPKLLIYSGSTLQSGVPSR<br>FSGSGSGTEFTLTISSLQPEDFATYYCQQHNKYPYTFGGGTKVEIK |
| hzCAR123-30 NT | 95 | ATGGCCCTCCCTGTCACCGCCCTGCTGCTTCCGCTGGCTCTTCTGCTCCACGCCGCTCGGC<br>CCGAAGTGGTGCTGACCCAGTCGCCCGCAACCCTCTCTCTGTCGCCGGGAGAACGCGCCAC<br>TCTTTCCTGTCGGGCGTCCAAGAGCATCTCAAAGGACCTCGCCTGGTACCAGCAGAAGCCT<br>GGTCAAGCCCCGCGGCTGCTGATCTACTCCGGCTCCACGCTGCAATCAGGAATCCCAGCCA<br>GATTTTCCGGTTCGGGGTCGGGACTGACTTCACCTTGACCATTAGCTCGCTGGAACCTGA<br>GGACTTCGCCGTGTATTACTGCCAGCAGCACAACAAGTACCCGTACACCTTCGGAGGCGGT<br>ACTAAGGTCGAGATCAAGGGGGGTGGCGGTAGCGGAGGAGGGGGCTCCGGCGGCGGCGGCT<br>CAGGGGGCGGAGGAAGCGAAGTGCAGCTCGTCGAGAGCGGAGGGGGACTGGTGCAGCCCGG<br>AGGAAGCCTGAGGCTGTCCTGCGCTGCCTCCGGCTACACCTTCACCTCCTACTGGATGAAC<br>TGGGTCAGACAGGCACCTGGAAAGGGACTGGTCTGGGTGTCGCGCATTGACCCCTACGACT<br>CCGAAACCCATTACAATCAGAAATTCAAGGACCGCTTCACCATCTCCGTGGACAAAGCCAA<br>GAGCACCGCGTACCTCCAAATGAACTCCCTGCGCGCTGAGGATACAGCAGTGTACTATTGC<br>GCCCGGGGAAACTGGGATGATTACTGGGGCCAGGGAACTACTGTGACTGTGTCATCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc<br>gcctgcgatatctactttgggccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttgtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaaggggaacgcagaagaggcaaaggccacgacggactgtaccagggactcag<br>caccgccaccaaggacacctatgacgctcttcacatgcaggccctgccgcctcgg |
| hzCAR123-30 AA | 154 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-30 scFv | 213 | MALPVTALLLPLALLLHAARPEVVLTQSPATLSLSPGERATLSCRASKSISKDLAWYQQK<br>PGQAPRLLIYSGSTLQSGIPARFSGSGSGTDFTLTISSLEPEDFAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-30 VH | 272 | EVQLVESGGGLVQPGGSLRLSCAASGYTFTSYWMNWVRQAPGKGLVWVSRIDPYDSETHYN<br>QKFKDRFTISVDKAKSTAYLQMNSLRAEDTAVYYCARGNWDDYWGQGTTVTVSS |
| hzCAR123-30 VL | 331 | EVVLTQSPATLSLSPGERATLSCRASKSISKDLAWYQQKPGQAPRLLIYSGSTLQSGIPAR<br>FSGSGSGTDFTLTISSLEPEDFAVYYCQQHNKYPYTFGGGTKVEIK |
| hzCAR123-31 NT | 96 | ATGGCCCTCCCTGTCACCGCCCTGCTGCTTCCGCTGGCTCTTCTGCTCCACGCCGCTCGGC<br>CCGACGTCGTGATGACCCAGTCACCGGCATTCCTGTCCGTGACTCCCGGAGAAAAGGTCAC<br>GATTACTTGCCGGGCGTCCAAGAGCATCTCCAAGGACCTCGCCTGGTACCAACAGAAGCCG<br>GACCAGGCCCCTAAGCTGTTGATCTACTCGGGTCCACCCTTCAATCGGGAGTGCCATCGC<br>GGTTTAGCGGTTCGGGTTCTGGGACCGACTTCACTTTCACCATCTCCTCACTGGAAGCCGA<br>GGATGCCGCCACTTACTACTGTCAGCAGCACAACAAGTATCCGTACACCTTCGGAGGCGGT<br>ACCAAAGTGGAGATCAAGGGGGGTGGCGGTAGCGGAGGAGGGGGCTCCGGCGGCGGCGGCT<br>CAGGGGGCGAGGAAGCGAAGTGCAGCTCGTCGAGAGCGGAGGGGGACTGGTGCAGCCCGG<br>AGGAAGCCTGAGGCTGTCCTGCGCTGCCTCCGGCTACACCTTCACCTCCTACTGGATGAAC<br>TGGGTCAGACAGGCACCTGGAAAGGGACTGGTCTGGGTGTCGCGCATTGACCCCTACGACT<br>CCGAAACCCATTACAATCAGAAATTCAAGGACCGCTTCACCATCTCCGTGGACAAAGCCAA<br>GAGCACCGCGTACCTCCAAATGAACTCCCTGCGCGCTGAGGATACAGCAGTGTACTATTGC<br>GCCCGGGGAAACTGGGATGATTACTGGGGCCAGGGAACTACTGTGACTGTGTCATCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccggggtcttgacttc |

TABLE 6-continued

Humanized CD123 CAR Sequences

| Name | SEQ ID | Sequence |
|---|---|---|
| | | gcctgcgatatctacatttgggcccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-31 AA | 155 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-31 scFv | 214 | MALPVTALLLPLALLLHAARPDVVMTQSPAFLSVTPGEKVTITCRASKSISKDLAWYQQK<br>PDQAPKLLIYSGSTLQSGVPSRFSGSGSGTDFTFTISSLEAEDAATYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-31 VH | 273 | EVQLVESGGGLVQPGGSLRLSCAASGYTFTSYWMNWVRQAPGKGLVWVSRIDPYDSETHYN<br>QKFKDRFTISVDKAKSTAYLQMNSLRAEDTAVYYCARGNWDDYWGQGTTVTVSS |
| hzCAR123-31 VL | 332 | DVVMTQSPAFLSVTPGEKVTITCRASKSISKDLAWYQQKPDQAPKLLIYSGSTLQSGVPSR<br>FSGSGSGTDFTFTISSLEAEDAATYYCQQHNKYPYTFGGGTKVEIK |
| hzCAR123-32 NT | 97 | ATGGCCCTCCCTGTCACCGCCCTGCTGCTTCCGCTGGCTCTTCTGCTCCACGCCGCTCGGC<br>CCGACGTGGTCATGACTCAGTCCCCGGACTCACTCGCGGTGTCGCTTGGAGAGAGAGCGAC<br>CATCAACTGTCGGGCCTCAAAGAGCATCAGCAAGGACCTGGCCTGGTACCAGCAGAAGCCG<br>GGACAGCCGCCAAAGCTGCTGATCTACTCCGGGTCCACCTTGCAATCTGGTGTCCCTGACC<br>GGTTCTCCGGTTCCGGGTCGGGTACCGACTTCACGCTCACTATTTCGTCGCTGCAAGCCGA<br>AGATGTGGCCGTGTACTATTGCCAACAGCACAACAAGTACCCCTACACTTTTGGCGGAGGC<br>ACCAAGGTGGAAATCAAGGGGGGTGGCGGTAGCGGAGGAGGGGCTCCGGCGGCGGCGGCT<br>CAGGGGGCGGAGGAAGCGAAGTGCAGCTCGTCGAGAGCGGAGGGGGACTGGTGCAGCCCGG<br>AGGAAGCCTGAGGCTGTCCTGCGCTGCCTCCGGCTACACCTTCACCTCCTACTGGATGAAC<br>TGGGTCAGACAGGCACCTGGAAAGGGACTGGTCTGGGTGTCGCGCATTGACCCCTACGACT<br>CCGAAACCCATTACAATCAGAAATTCAAGGACCGCTTCACCATCTCCGTGGACAAAGCCAA<br>GAGCACCGCGTACCTCCAAATGAACTCCCTGCGCGCTGAGGACACAGCAGTGTACTATTGC<br>GCCCGGGGAAACTGGGATGATTACTGGGGCCAGGGAACTACTGTGACTGTGTCATCCACCA<br>CTACCCCAGCACCGAGGCCACCCACCCCGGCTCCTACCATCGCCTCCCAGCCTCTGTCCCT<br>GCGTCCGGAggcatgtagacccgcagctggtggggccgtgcatacccgggggtcttgacttc<br>gcctgcgatatctacatttgggcccctctggctggtacttgcggggtcctgctgctttcac<br>tcgtgatcactctttactgtaagcgcggtcggaagaagctgctgtacatctttaagcaacc<br>cttcatgaggcctgtgcagactactcaagaggaggacggctgttcatgccggttcccagag<br>gaggaggaaggcggctgcgaactgcgcgtgaaattcagccgcagcgcagatgctccagcct<br>acaagcaggggcagaaccagctctacaacgaactcaatcttggtcggagagaggagtacga<br>cgtgctggacaagcggagaggacgggacccagaaatgggcgggaagccgcgcagaaagaat<br>ccccaagagggcctgtacaacgagctccaaaaggataagatggcagaagcctatagcgaga<br>ttggtatgaaagggaacgcagaagaggcaaaggccacgacggactgtaccagggactcag<br>caccgccaccaaggacacctatgacgctcttcacatgcaggccctgccgcctcgg |
| hzCAR123-32 AA | 156 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSSTTTPAPRPPTPAPTIASQPLSLRPEACRPAAGGAVHT<br>RGLDFACDIYIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDKRRGRDPEMG<br>GKPRRKNPQEGLYNELQKDKMAEAYSEIGMKGERRRGKGHDGLYQGLSTATKDTYDALHM<br>QALPPR |
| hzCAR123-32 scFv | 215 | MALPVTALLLPLALLLHAARPDVVMTQSPDSLAVSLGERATINCRASKSISKDLAWYQQK<br>PGQPPKLLIYSGSTLQSGVPDRFSGSGSGTDFTLTISSLQAEDVAVYYCQQHNKYPYTFG<br>GGTKVEIKGGGGSGGGGSGGGGSGGGGSEVQLVESGGGLVQPGGSLRLSCAASGYTFTSY<br>WMNWVRQAPGKGLVWVSRIDPYDSETHYNQKFKDRFTISVDKAKSTAYLQMNSLRAEDTA<br>VYYCARGNWDDYWGQGTTVTVSS |
| hzCAR123-32 VH | 274 | EVQLVESGGGLVQPGGSLRLSCAASGYTFTSYWMNWVRQAPGKGLVWVSRIDPYDSETHYN<br>QKFKDRFTISVDKAKSTAYLQMNSLRAEDTAVYYCARGNWDDYWGQGTTVTVSS |

TABLE 6-continued

Humanized CD123 CAR Sequences

| Name | SEQ ID | Sequence |
|---|---|---|
| hzCAR123-32 VL | 333 | DVVMTQSPDSLAVSLGERATINCRASKSISKDLAWYQQKPGQPPKLLIYSGSTLQSGVPDR FSGSGSGTDFTLTISSLQAEDVAVYYCQQHNKYPYTFGGGTKVEIK |

In embodiments, a CAR molecule described herein comprises a scFv that specifically binds to CD123, and does not contain a leader sequence, e.g., the amino acid sequence SEQ ID NO: 1. Table 9 below provides amino acid and nucleotide sequences for CD123 scFv sequences that do not contain a leader sequence SEQ ID NO: 1.

TABLE 9

CD123 CAR scFv sequences

| Name | SEQ ID | Sequence |
|---|---|---|
| CAR123-2 scFv - NT | 479 | CAAGTGCAACTCGTCCAAAGCGGAGCGGAAGTCAAGAAACCCGGAGCGAGCGTGAAAGTG TCCTGCAAAGCCTCCGGCTACACCTTTACGGGCTACTACATGCACTGGGTGCGCCAGGCA CCAGGACAGGGTCTTGAATGGATGGGATGGATCAACCCTAATTCGGGCGGAACTAACTAC GCACAGAAGTTCCAGGGGAGAGTGACTCTGACTCGGGATACCTCCATCTCAACTGTCTAC ATGGAACTCTCCCGCTTGCGGTCAGATGATACGGCAGTGTACTACTGCGCCCGCGACATG AATATCCTGGCTACCGTGCCGTTCGACATCTGGGGACAGGGGACTATGGTTACTGTCTCA TCGGGCGGTGGAGGTTCAGGAGGAGGCGGCTCGGGAGGCGGAGGTTCGGACATTCAGATG ACCCAGTCCCCATCCTCTCTGTCGGCCAGCGTCGGAGATAGGGTGACCATTACCTGTCGG GCCTCGCAAAGCATCTCCTCGTACCTCAACTGGTATCAGCAAAAGCCGGGAAAGGCGCCT AAGCTGCTGATCTACGCCGCTTCGAGCTTGCAAAGCGGGGTGCCATCCAGATTCTCGGGA TCAGGCTCAGGAACCGACTTCACCCTGACCGTGAACAGCCTCCAGCCGGAGGACTTTGCC ACTTACTACTGCCAGCAGGGAGACTCCGTGCCGCTTACTTTCGGGGGGGGTACCCGCCTG GAGATCAAG |
| CAR123-2 scFv - AA | 480 | QVQLVQSGAEVKKPGASVKVSCKASGYTFTGYYMHWVRQAPGQGLEWMGWINPNSGGTNY AQKFQGRVTLTRDTSISTVYMELSRLRSDDTAVYYCARDMNILATVPFDIWGQGTMVTVS SGGGGSGGGGSGGGGSDIQMTQSPSSLSASVGDRVTITCRASQSISSYLNWYQQKPGKAP KLLIYAASSLQSGVPSRFSGSGSGTDFTLTVNSLQPEDFATYYCQQGDSVPLTFGGGTRL EIK |
| CAR123-2 ORF-free NT | 481 | atggccctccctgtcaccgccctgctgcttccgctggctcttctgctccacgccgctcggccccaagtgcaactcgtccaaagcg gagcggaagtcaagaaacccggagcgagcgtgaaagtgtcctgcaaagcctccggctacacctttacgggctactacatgcact gggtgcgccaggcaccaggacagggtcttgaatggatgggatggatcaaccctaattcgggcggaactaactacgcacagaag ttccaggggagagtgactctgactcgggatacctccatctcaactgtctacatggaactctcccgcttgcggtcagatgatacggc agtgtactactgcgcccgcgacatgaatatcctggctaccgtgccgttcgacatctggggacaggggactatggttactgtctcat cgggcggtggaggttcaggaggaggcggctcgggaggcggaggttcggacattcagatgacccagtcccccatcctctctgtcg gccagcgtcggagataggggtgaccattacctgtcgggcctcgcaaagcatctcctcgtacctcaactggtatcagcaaaagccg ggaaaggcgcctaagctgctgatctacgccgcttcgagcttgcaaagcggggtgccatccagattctcgggatcaggctcagga accgacttcaccctgaccgtgaacagcctccagccggaggactttgccacttactactgccagcagggagactccgtgccgctta cttcgggggggtacccgcctggagatcaagaccactacccccagcaccgaggccaccccccggctcctaccatcgcctcc cagcctctgtccctcgctccggaggcatgtagacccgcagctggtgggccgtgcatacccggggtcttgacttcgcctgcgat atctacatttgggcccctctggctggtacttgcgggtcctgctgctttcactcgtgatcactctttactgtaagcgcggtcggaaga agctgctgtacatattaagcaaccctttcatgaggcctgtgcagactactcaagaggaggacggctgttcttgccggttcccagag gaggaggaaggcggctgcgaactgcgcgtgaaattcagccgcagcgcagacgctccagcctacaagcaggggcagaacca gctctacaacgaactcaatcttggtcggagagaggagtacgacgtgctggacaagcggagagagacgggaccccagaaatgggc gggaagccgcgcagaaagaatccccaagagggcctgtacaacgagctccaaaaggataagatggcagaagcctatagcgag attggtatgaaaggggaacgcagaagaggcaaaggccacgacggactgtaccagggactcagcaccgccaccaaggacacc tatgacgctcttcacatgcaggccctgccgcctcggtaagtcgacagctcgattcttgctgtccaatttctattaaaggttcctttgttc cctaagtccaactactaaactgggggatattatgaagggccttgagcatctggattctgcctaataaaaaacatttattttcattgctgc gtcgagagctcgctttcttgctgtccaatttctattaaaggttcctttgttccctaagtccaactactaaactgggggatattatgaagg gccttgagcatctggattctgcctaataaaaaacatttattttcattgctgcctcgacgaattc |
| CAR123-3 scFv - NT | 482 | CAAGTCCAACTCGTTCAATCCGGCGCAGAAGTCAAGAAGCCAGGAGCATCAGTGAAAGTG TCCTGCAAAGCCTCAGGCTACATCTTCACGGGATACTACATCCACTGGGTGCGCCAGGCT CCGGGCCAGGGCCTTGAGTGGATGGGCTGGATCAACCCTAACTCTGGGGGAACCAACTAC GCTCAGAAGTTCCAGGGGAGGGTCACTATGACTCGCGATACCTCCATCTCCACTGCGTAC ATGGAACTCTCGGGACTGAGATCGACGATCCTGCCGTGTACTACTGCGCCCGGGACATG AACATCTTGGCGACCGTGCCGTTTGACATTTGGGGACAGGGCACCCTCGTCACTGTGTCG AGCGGTGGAGGAGGCTCGGGGGGTGGCGGATCAGGAGGGGGAGGAAGCGACATCCAGCTG ACTCAGAGCCCATCGTCGTTGTCCGCGTCGGTGGGGGATAGAGTGACCATTACTTGCCGC GCCAGCCAGAGCATCTCATCATATCTGAATTGGTACCAGCAGAAGCCCGGAAAGGCCCCA AAACTGCTGATCTACGCTGCAAGCAGCCTCCAATCGGGAGTGCCGTCACGGTTCTCCGGG TCCGGTTCGGGAACTGACTTTACCCTGACCGTGAATTCGCTGCAACCGGAGGATTTCGCC ACGTACTACTGTCAGCAAGGAGACTCCGTGCCGCTGACCTTCGGTGGAGGCACCAAGGTC GAAATCAAG |

TABLE 9-continued

CD123 CAR scFv sequences

| Name | SEQ ID | Sequence |
|---|---|---|
| CAR123-3 scFv - AA | 483 | QVQLVQSGAEVKKPGASVKVSCKASGYIFTGYYIHWVRQAPGQGLEWMGWINPNSGGTNY AQKFQGRVTMTRDTSISTAYMELSGLRSDDPAVYYCARDMNILATVPFDIWGQGTLVTVS SGGGGSGGGGSGGGGSDIQLTQSPSSLSASVGDRVTITCRASQSISSYLNWYQQKPGKAP KLLIYAASSLQSGVPSRFSGSGSGTDFTLTVNSLQPEDFATYYCQQGDSVPLTFGGGTKV EIK |
| CAR123-4 scFv - NT | 484 | CAAGTCCAACTCCAACAGTCAGGCGCAGAAGTGAAAAAGAGCGGTGCATCGGTGAAAGTG TCATGCAAAGCCTCGGGCTACACCTTCACTGACTACTATATGCACTGGCTGCGGCAGGCA CCGGGACAGGGACTTGAGTGGATGGGATGGATCAACCCGAATTCAGGGGACACTAACTAC GCGCAGAAGTTCCAGGGGAGAGTGACCCTGACGAGGGACACCTCAATTTCGACCGTCTAC ATGGAATTGTCGCGCCTGAGATCGGACGATACTGCTGTGTACTACTGTGCCCGCGACATG AACATCCTCGCGACTGTGCCTTTTGATATCTGGGGACAGGGGACTATGGTCACCGTTTCC TCCGCTTCCGGTGGCGGAGGCTCGGGAGGCCGGGCCTCCGGTGGAGGAGGCAGCGACATC CAGATGACTCAGAGCCCTTCCTCGCTGAGCGCCTCAGTGGGAGATCGCGTGACCATCACT TGCCGGGCCAGCCAGTCCATTTCGTCCTACCTCAATTGGTACCAGCAGAAGCCGGGAAAG GCGCCCAAGCTCTTGATCTACGCTGCGAGCTCCCTGCAAAGCGGGGTGCCGAGCCGATTC TCGGGTTCCGGCTCGGGAACCGACTTCACTCTGACCATCTCATCCCTGCAACCAGAGGAC TTTGCCACCTACTACTGCCAACAAGGAGATTCTGTCCCACTGACGTTCGGCGGAGGAACC AAGGTCGAAATCAAG |
| CAR123-4 scFv - AA | 485 | QVQLQQSGAEVKKSGASVKVSCKASGYTFTDYYMHWLRQAPGQGLEWMGWINPNSGDTNY AQKFQGRVTLTRDTSISTVYMELSRLSDDTAVYYCARDMNILATVPFDIWGQGTMVTVS SASGGGGSGGRASGGGGSDIQMTQSPSSLSASVGDRVTITCRASQSISSYLNWYQQKPGK APKLLIYAASSLQSGVPSRFSGSGSGTDFTLTISSLQPEDFATYYCQQGDSVPLTFGGGT KVEIK |
| CAR123-1 scFv - AA | 478 | QVQLVQSGAEVKKPGASVKVSCKASGYTFTGYYMHWVRQAPGQGLEWMGWINPNSGGTNY AQKFQGRVTMTRDTSISTAYMELSRLSDDTAVYYCARDMNILATVPFDIWGQGTMVTVS SGGGGSGGGGSGGGGSDIQMTQSPSSLSASVGDRVTITCRASQSISTYLNWYQQKPGKAP NLLIYAAFSLQSGVPSRFSGSGSGTDFTLTINSLQPEDFATYYCQQGDSVPLTFGGGTKL EIK |
| hzCAR123-1 scFv | 556 | QVQLVQSGAEVKKPGASVKVSCKASGYTFTSYWMNWVRQAPGQGLEWMGRIDPYDSETHY NQKFKDRVTMTVDKSTSTAYMELSSLRSEDTAVYYCARGNWDDYWGQGTTVTVSSGGGGS GGGGSGGGGSGGGGSDVQLTQSPSFLSASVGDRVTITCRASKSISKDLAWYQQKPGKAPK LLIYSGSTLQSGVPSRFSGSGSGTEFTLTISSLQPEDFATYYCQQHNKYPYTFGGGTKVE IK |
| hzCAR123-2 scFv | 557 | QVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTFGGGTKVEIK |
| hzCAR123-3 scFv | 558 | QVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIK |
| hzCAR123-4 scFv | 559 | QVQLVQSGAEVKKPGASVKVSCKASGYTFTSYWMNWVRQ APGQGLEWMGRIDPYDSETHYNQKFKDRVTMTVDKSTSTAYMELSSLRSEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-5 scFv | 560 | DVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-6 scFv | 561 | EVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-7 scFv | 562 | DVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |

TABLE 9-continued

CD123 CAR scFv sequences

| Name | SEQ ID | Sequence |
|---|---|---|
| hzCAR123-8 scFv | 563 | DVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSQVQLVQSGAEVKKPGASVKVSCKASGYTFTSY WMNWVRQAPGQGLEWMGRIDPYDSETHYNQKFKDRVTMTVDKSTSTAYMELSSLRSEDTA VYYCARGNWDDYWGQGTTVTVSS |
| hzCAR123-9 scFv | 564 | QVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSDVQLTQSPSFLSASVGDRVTITCR ASKSISKDLAWYQQKPGKAPKLLIYSGSTLQSGVPSRFSGSGSGTEFTLTISSLQPEDFA TYYCQQHNKYPYTFGGGTKVEIK |
| hzCAR123-10 scFv | 565 | QVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTFGGGTKVEIK |
| hzCAR123-11 scFv | 566 | QVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSDVVMTQSPAFLSVTPGEKVTITCR ASKSISKDLAWYQQKPDQAPKLLIYSGSTLQSGVPSRFSGSGSGTDFTFTISSLEAEDAA TYYCQQHNKYPYTFGGGTKVEIK |
| hzCAR123-12 scFv | 567 | QVQLVQSGSELKKPGASVKVSCKASGYTFTSYWMNWVRQ APGQGLEWMGRIDPYDSETHYNQKFKDRFVFSVDKSVSTAYLQISSLKAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-13 scFv | 568 | DVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSS |
| hzCAR123-14 scFv | 569 | EVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSS |
| hzCAR123-15 scFv | 570 | DVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSS |
| hzCAR123-16 scFv | 571 | DVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSQVQLVQSGSELKKPGASVKVSCKASGYTFTSY WMNWVRQAPGQGLEWMGRIDPYDSETHYNQKFKDRFVFSVDKSVSTAYLQISSLKAEDTA VYYCARGNWDDYWGQGTTVTVSS |
| hzCAR123-17 scFv | 572 | EVQLVQSGAEVKKPGESLRISCKGSGYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSDVQLTQSPSFLSASVGDRVTITCR ASKSISKDLAWYQQKPGKAPKLLIYSGSTLQSGVPSRFSGSGSGTEFTLTISSLQPEDFA TYYCQQHNKYPYTFGGGTKVEIK |
| hzCAR123-18 scFv | 573 | EVQLVQSGAEVKKPGESLRISCKGSGYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTEGGGTKVEIK |
| hzCAR123-19 scFv | 574 | EVQLVQSGAEVKKPGESLRISCKGSGYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSDVVMTQSPAELSVTPGEKVTITCR ASKSISKDLAWYQQKPDQAPKLLIYSGSTLQSGVPSRFSGSGSGTDFTFTISSLEAEDAA TYYCQQHNKYPYTEGGGTKVEIK |

TABLE 9-continued

CD123 CAR scFv sequences

| Name | SEQ ID | Sequence |
|---|---|---|
| hzCAR123-20 scFv | 575 | EVQLVQSGAEVKKPGESLRISCKGSYTFTSYWMNWVRQ MPGKGLEWMGRIDPYDSETHYNQKFKDHVTISVDKSISTAYLQWSSLKASDTAMYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTEGGGTKVEIK |
| hzCAR123-21 scFv | 576 | DVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVQSGAEVKKPGESLRISCKGSYTFTSY WMNWVRQMPGKGLEWMGRIDPYDSETHYNQKFKDHVTISVDKSISTAYLQWSSLKASDTA MYYCARGNWDDYWGQGTTVTVSS |
| hzCAR123-22 scFv | 577 | EVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGGSGGGGSGGGGSGGGGSEVQLVQSGAEVKKPGESLRISCKGSYTFTSY WMNWVRQMPGKGLEWMGRIDPYDSETHYNQKFKDHVTISVDKSISTAYLQWSSLKASDTA MYYCARGNWDDYWGQGTTVTVSS |
| hzCAR123-23 scFv | 578 | DVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSEVQLVQSGAEVKKPGESLRISCKGSYTFTSY WMNWVRQMPGKGLEWMGRIDPYDSETHYNQKFKDHVTISVDKSISTAYLQWSSLKASDTA MYYCARGNWDDYWGQGTTVTVSS |
| hzCAR123-24 scFv | 579 | DVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSEVQLVQSGAEVKKPGESLRISCKGSYTFTSY WMNWVRQMPGKGLEWMGRIDPYDSETHYNQKFKDHVTISVDKSISTAYLQWSSLKASDTA MYYCARGNWDDYWGQGTTVTVSS |
| hzCAR123-25 scFv | 580 | EVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVQLTQSPSELSASVGDRVTITCR ASKSISKDLAWYQQKPGKAPKLLIYSGSTLQSGVPSRFSGSGSGTEFTLTISSLQPEDFA TYYCQQHNKYPYTEGGGTKVEIK |
| hzCAR123-26 scFv | 581 | EVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSEVVLTQSPATLSLSPGERATLSCR ASKSISKDLAWYQQKPGQAPRLLIYSGSTLQSGIPARFSGSGSGTDFTLTISSLEPEDFA VYYCQQHNKYPYTEGGGTKVEIK |
| hzCAR123-27 scFv | 582 | EVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPAELSVTPGEKVTITCR ASKSISKDLAWYQQKPDQAPKLLIYSGSTLQSGVPSRFSGSGSGTDFTFTISSLEAEDAA TYYCQQHNKYPYTEGGGTKVEIK |
| hzCAR123-28 scFv | 583 | EVQLVESGGGLVQPGGSLRLSCAASGYTFTSYWMNWVRQ APGKGLVWVSRIDPYDSETHYNQKFKDRFTISVDKAKSTAYLQMNSLRAEDTAVYYCARG NWDDYWGQGTTVTVSSGGGGSGGGGSGGGGSGGGGSDVVMTQSPDSLAVSLGERATINCR ASKSISKDLAWYQQKPGQPPKLLIYSGSTLQSGVPDRFSGSGSGTDFTLTISSLQAEDVA VYYCQQHNKYPYTFGGGTKVEIK |
| hzCAR123-29 scFv | 584 | DVQLTQSPSFLSASVGDRVTITCRASKSISKDLAWYQQK PGKAPKLLIYSGSTLQSGVPSRFSGSGSGTEFTLTISSLQPEDFATYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSS |
| hzCAR123-30 scFv | 585 | EVVLTQSPATLSLSPGERATLSCRASKSISKDLAWYQQK PGQAPRLLIYSGSTLQSGIPARFSGSGSGTDFTLTISSLEPEDFAVYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSS |
| hzCAR123-31 scFv | 586 | DVVMTQSPAFLSVTPGEKVTITCRASKSISKDLAWYQQK PDQAPKLLIYSGSTLQSGVPSRFSGSGSGTDFTFTISSLEAEDAATYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSS |

TABLE 9-continued

CD123 CAR scFv sequences

| Name | SEQ ID | Sequence |
|---|---|---|
| hzCAR123-32 scFv | 587 | DVVMTQSPDSLAVSLGERATINCRASKSISKDLAWYQQK PGQPPKLLIYSGSTLQSGVPDRFSGSGSGTDFTLTISSLQAEDVAVYYCQQHNKYPYTFG GGTKVEIKGGGGSGGGGSGGGGSGGGGSEVQLVESGGGLVQPGGSLRLSCAASGYTFTSY WMNWVRQAPGKGLVWVSRIDPYDSETHYNQKFKDRFTISVDKAKSTAYLQMNSLRAEDTA VYYCARGNWDDYWGQGTTVTVSS |

In embodiments, the CAR scFv fragments were then cloned into lentiviral vectors to create a full length CAR construct in a single coding frame, and using the EF1 alpha promoter for expression (SEQ ID NO: 11).

```
EF1 alpha promoter
CGTGAGGCTCCGGTGCCCGTCAGTGGGCAGAGCGCACATCGCCCACAGTCCCCGAGAAGTTGGGGGGAGGGGTCGG

CAATTGAACCGGTGCCTAGAGAAGGTGGCGCGGGGTAAACTGGGAAAGTGATGTCGTGTACTGGCTCCGCCTTTTT

CCCGAGGGTGGGGGAGAACCGTATATAAGTGCAGTAGTCGCCGTGAACGTTCTTTTTCGCAACGGGTTTGCCGCCA

GAACACAGGTAAGTGCCGTGTGTGGTTCCCGCGGGCCTGGCCTCTTTACGGGTTATGGCCCTTGCGTGCCTTGAAT

TACTTCCACCTGGCTGCAGTACGTGATTCTTGATCCCGAGCTTCGGGTTGGAAGTGGGTGGGAGAGTTCGAGGCCT

TGCGCTTAAGGAGCCCCTTCGCCTCGTGCTTGAGTTGAGGCCTGGCCTGGGCGCTGGGGCCGCCGCGTGCGAATCT

GGTGGCACCTTCGCGCCTGTCTCGCTGCTTTCGATAAGTCTCTAGCCATTTAAAATTTTTGATGACCTGCTGCGAC

GCTTTTTTCTGGCAAGATAGTCTTGTAAATGCGGGCCAAGATCTGCACACTGGTATTTCGGTTTTTGGGGCCGCG

GGCGGCGACGGGCCCGTGCGTCCCAGCGCACATGTTCGGCGAGGCGGGGCCTGCGAGCGCGGCCACCGAGAATCG

GACGGGGGTAGTCTCAAGCTGGCCGGCCTGCTCTGGTGCCTGGCCTCGCGCCGCCGTGTATCGCCCCGCCCTGGGC

GGCAAGGCTGGCCCGGTCGGCACCAGTTGCGTGAGCGGAAAGATGGCCGCTTCCCGGCCCTGCTGCAGGGAGCTCA

AAATGGAGGACGCGGCGCTCGGGAGAGCGGGCGGGTGAGTCACCCACACAAAGGAAAAGGGCCTTTCCGTCCTCAG

CCGTCGCTTCATGTGACTCCACGGAGTACCGGGCGCCGTCCAGGCACCTCGATTAGTTCTCGAGCTTTTGGAGTAC

GTCGTCTTTAGGTTGGGGGGAGGGGTTTTATGCGATGGAGTTTCCCCACACTGAGTGGGTGGAGACTGAAGTTAGG

CCAGCTTGGCACTTGATGTAATTCTCCTTGGAATTTGCCCTTTTTGAGTTTGGATCTTGGTTCATTCTCAAGCCTC

AGACAGTGGTTCAAAGTTTTTTTCTTCCATTTCAGGTGTCGTGA

Gly/Ser (SEQ ID NO: 25)
GGGGS

Gly/Ser (SEQ ID NO: 26): This sequence may encompass 1-6 "Gly Gly Gly Gly Ser"
repeating units
GGGGSGGGGS GGGGSGGGGS GGGGSGGGGS Gly/Ser (SEQ ID NO: 27)
GGGGSGGGGS GGGGSGGGGS Gly/Ser (SEQ ID NO: 28)
GGGGSGGGGS GGGGS Gly/Ser (SEQ ID NO: 29)
GGGS PolyA: (A)$_{5000}$ (SEQ ID NO: 30)
This sequence may encompass 50-5000 adenines.

PolyA: (T)$_{100}$ (SEQ ID NO: 31)

PolyA: (T)$_{5000}$ (SEQ ID NO: 32)
This sequence may encompass 50-5000 thymines.

PolyA: (A)$_{5000}$ (SEQ ID NO: 33)
This sequence may encompass 100-5000 adenines.

PolyA: (A)$_{400}$ (SEQ ID NO: 34)
This sequence may encompass 100-400 adenines.
```

-continued

PolyA: (A)₂₀₀₀ (SEQ ID NO: 35)
This sequence may encompass 50-2000 adenines.

Gly/Ser (SEQ ID NO: 709): This sequence may encompass 1-10 "Gly Gly Gly Ser"
repeating units
GGGSGGGSGG GSGGGSGGGS GGGSGGGSGG GSGGGSGGGS The CAR scFv fragments can be cloned into lentiviral vectors to create a full length CAR construct in a single coding frame, and using the EF1 alpha promoter for expression (SEQ ID NO: 11).

The CAR construct can include a Gly/Ser linker having one or more of the following sequences: GGGGS (SEQ ID NO:25); encompassing 1-6 "Gly Gly Gly Gly Ser" repeating units, e.g., GGGGSGGGGS GGGGSGGGGS GGGGSGGGGS (SEQ ID NO:26); GGGGSGGGGS GGGGSGGGGS (SEQ ID NO:27); GGGGSGGGGS GGGGS (SEQ ID NO:28); GGGS (SEQ ID NO:29); or encompassing 1-10 "Gly Gly Gly Ser" repeating units, e.g., GGGSGGGSGG GSGGGSGGGS GGGSGGGSGG GSGGGSGGGS (SEQ ID NO:709). In embodiments, the CAR construct include a poly A sequence, e.g., a sequence encompassing 50-5000 or 100-5000 adenines (e.g., SEQ ID NO:30, SEQ ID NO:33, SEQ ID NO:34 or SEQ ID NO:35), or a sequence encompassing 50-5000 thymines (e.g., SEQ ID NO:31, SEQ ID NO:32). Alternatively, the CAR construct can include, for example, a linker including the sequence GSTSGSGKPGSGEGSTKG (SEQ ID NO: 704)

Bispecific CARs

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multi-specific (e.g., a bispecific or a trispecific) antibody molecule. Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments cross-linked through sulfhdryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecifc, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837,821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus further associated with VL domains to form a series of FVs (or scFVs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. Nos. 5,910,573, 5,932,448, 5,959,083, 5,989,830, 6,005, 079, 6,239,259, 6,294,353, 6,333,396, 6,476,198, 6,511,663, 6,670,453, 6,743,896, 6,809,185, 6,833,441, 7,129,330, 7,183,076, 7,521,056, 7,527,787, 7,534,866, 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, U2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Within each antibody or antibody fragment (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$. Optionally, a linker is disposed between the two antibodies or antibody fragments (e.g., scFvs), e.g., between $VL_1$ and $VL_2$ if the construct is arranged as $VH_1$-$VL_1$-$VL_2$-$VH_2$, or between $VH_1$ and $VH_2$ if the construct is arranged as $VL_1$-$VH_1$-$VH_2$-$VL_2$. The linker may be a linker as described herein, e.g., a (Gly$_4$-Ser)n linker, wherein n is 1, 2, 3, 4, 5, or 6, preferably 4 (SEQ ID NO: 64). In general, the linker between the two scFvs should be long enough to avoid mispairing between the domains of the two scFvs. Optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In one aspect, the bispecific antibody molecule is characterized by a first immunoglobulin variable domain sequence, e.g., a scFv, which has binding specificity for CD123, e.g., comprises a scFv as described herein, e.g., as described in Table 2, Table 6, or Table 9, or comprises the light chain CDRs and/or heavy chain CDRs from a CD123 scFv described herein, and a second immunoglobulin variable domain sequence that has binding specificity for a second epitope on a different antigen. In some aspects the second immunoglobulin variable domain sequence has binding specificity for an antigen expressed on AML cells, e.g., an antigen other than CD123. For example, the second immunoglobulin variable domain sequence has binding specificity for CLL-1. As another example, the second immunoglobulin variable domain sequence has binding specificity for CD33. As another example, the second immunoglobulin variable domain sequence has binding specificity for CD34. As another example, the second immunoglobulin variable domain sequence has binding specificity for FLT3. For example, the second immunoglobulin variable domain sequence has binding specificity for folate receptor beta. In some aspects, the second immunoglobulin variable domain sequence has binding specificity for an antigen expressed on B-cells, for example, CD19, CD20, CD22 or ROR1.

Chimeric TCR

In one aspect, the CD123 antibodies and antibody fragments of the present invention (for example, those disclosed in Tables 2, 6 or 9) can be grafted to one or more constant domain of a T cell receptor ("TCR") chain, for example, a TCR alpha or TCR beta chain, to create an chimeric TCR that binds specificity to CD123. Without being bound by theory, it is believed that chimeric TCRs will signal through the TCR complex upon antigen binding. For example, a CD123 scFv as disclosed herein, can be grafted to the constant domain, e.g., at least a portion of the extracellular constant domain, the transmembrane domain and the cytoplasmic domain, of a TCR chain, for example, the TCR alpha chain and/or the TCR beta chain. As another example, a CD123 antibody fragment, for example a VL domain as described herein, can be grafted to the constant domain of a TCR alpha chain, and a CD123 antibody fragment, for example a VH domain as described herein, can be grafted to the constant domain of a TCR beta chain (or alternatively, a VL domain may be grafted to the constant domain of the TCR beta chain and a VH domain may be grafted to a TCR alpha chain). As another example, the CDRs of a CD123 antibody or antibody fragment, e.g., the CDRs of a CD123 antibody or antibody fragment as described in Tables 3, 4, 5, 6, 7, 8, 10, 11, 12 or 13 may be grafted into a TCR alpha and/or beta chain to create a chimeric TCR that binds specifically to CD123. For example, the LCDRs disclosed herein may be grafted into the variable domain of a TCR alpha chain and the HCDRs disclosed herein may be grafted to the variable domain of a TCR beta chain, or vice versa. Such chimeric TCRs may be produced by methods known in the art (For example, Willemsen R A et al, Gene Therapy 2000; 7: 1369-1377; Zhang T et al, Cancer Gene Ther 2004; 11: 487-496; Aggen et al, Gene Ther. 2012 April; 19(4): 365-74).

Stability and Mutations

The stability of a CD123 binding domain, e.g., scFv molecules (e.g., soluble scFv) can be evaluated in reference to the biophysical properties (e.g., thermal stability) of a conventional control scFv molecule or a full length antibody. In one embodiment, the human scFv has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a control binding molecule (e.g. a conventional scFv molecule) in the described assays.

The improved thermal stability of the CD123 binding domain, e.g., scFv is subsequently conferred to the entire CART123 construct, leading to improved therapeutic properties of the CART123 construct. The thermal stability of the CD123 binding domain, e.g., scFv can be improved by at least about 2° C. or 3° C. as compared to a conventional antibody. In one embodiment, the CD123 binding domain, e.g., scFv has a 1° C. improved thermal stability as compared to a conventional antibody. In another embodiment, the CD123 binding domain, e.g., scFv has a 2° C. improved thermal stability as compared to a conventional antibody. In another embodiment, the scFv has a 4, 5, 6, 7, 8, 9, 10, 11, 12, 13, 14, 15° C. improved thermal stability as compared to a conventional antibody. Comparisons can be made, for example, between the scFv molecules disclosed herein and full length antibodies. Thermal stability can be measured using methods known in the art. For example, in one embodiment, Tm can be measured. Methods for measuring Tm and other methods of determining protein stability are described in more detail below.

Mutations in scFv alter the stability of the scFv and improve the overall stability of the scFv and the CART123 construct. Stability of the humanized or human scFv is determined using measurements such as Tm, temperature denaturation and temperature aggregation.

The binding capacity of the mutant scFvs can be determined using assays described in the Examples.

In one embodiment, the CD123 binding domain, e.g., scFv comprises at least one mutation such that the mutated scFv confers improved stability to the CART123 construct. In another embodiment, the CD123 binding domain, e.g., scFv comprises at least 1, 2, 3, 4, 5, 6, 7, 8, 9, 10 mutations arising from the humanization process such that the mutated scFv confers improved stability to the CART123 construct.
Methods of Evaluating Protein Stability The stability of an antigen binding domain may be assessed using, e.g., the methods described below. Such methods allow for the determination of multiple thermal unfolding transitions where the least stable domain either unfolds first or limits the overall stability threshold of a multidomain unit that unfolds cooperatively (e.g., a multidomain protein which exhibits a single unfolding transition). The least stable domain can be identified in a number of additional ways. Mutagenesis can be performed to probe which domain limits the overall stability. Additionally, protease resistance of a multidomain protein can be performed under conditions where the least stable domain is known to be intrinsically unfolded via DSC or other spectroscopic methods (Fontana, et al., (1997) Fold. Des., 2: R17-26; Dimasi et al. (2009) J. Mol. Biol. 393: 672-692). Once the least stable domain is identified, the sequence encoding this domain (or a portion thereof) may be employed as a test sequence in the methods.

a) Thermal Stability

The thermal stability of the compositions may be analyzed using a number of non-limiting biophysical or biochemical techniques known in the art. In certain embodiments, thermal stability is evaluated by analytical spectroscopy.

An exemplary analytical spectroscopy method is Differential Scanning Calorimetry (DSC). DSC employs a calorimeter which is sensitive to the heat absorbances that accompany the unfolding of most proteins or protein domains (see, e.g. Sanchez-Ruiz, et al., Biochemistry, 27: 1648-52, 1988). To determine the thermal stability of a protein, a sample of the protein is inserted into the calorimeter and the temperature is raised until the Fab or scFv unfolds. The temperature at which the protein unfolds is indicative of overall protein stability.

Another exemplary analytical spectroscopy method is Circular Dichroism (CD) spectroscopy. CD spectrometry measures the optical activity of a composition as a function of increasing temperature. Circular dichroism (CD) spectroscopy measures differences in the absorption of left-handed polarized light versus right-handed polarized light which arise due to structural asymmetry. A disordered or unfolded structure results in a CD spectrum very different from that of an ordered or folded structure. The CD spectrum reflects the sensitivity of the proteins to the denaturing effects of increasing temperature and is therefore indicative of a protein's thermal stability (see van Mierlo and Steemsma, J. Biotechnol., 79(3):281-98, 2000).

Another exemplary analytical spectroscopy method for measuring thermal stability is Fluorescence Emission Spectroscopy (see van Mierlo and Steemsma, supra). Yet another exemplary analytical spectroscopy method for measuring thermal stability is Nuclear Magnetic Resonance (NMR) spectroscopy (see, e.g. van Mierlo and Steemsma, supra).

The thermal stability of a composition can be measured biochemically. An exemplary biochemical method for assessing thermal stability is a thermal challenge assay. In a "thermal challenge assay", a composition is subjected to a range of elevated temperatures for a set period of time. For example, in one embodiment, test scFv molecules or molecules comprising scFv molecules are subject to a range of increasing temperatures, e.g., for 1-1.5 hours. The activity of the protein is then assayed by a relevant biochemical assay. For example, if the protein is a binding protein (e.g. an scFv or scFv-containing polypeptide) the binding activity of the binding protein may be determined by a functional or quantitative ELISA.

Such an assay may be done in a high-throughput format and those disclosed in the Examples using E. coli and high throughput screening. A library of CD123 binding domains, e.g., scFv variants may be created using methods known in the art. CD123 binding domains, e.g., scFv expression may be induced and the CD123 binding domains, e.g., scFv may be subjected to thermal challenge. The challenged test samples may be assayed for binding and those CD123 binding domains, e.g., scFvs which are stable may be scaled up and further characterized.

Thermal stability is evaluated by measuring the melting temperature (Tm) of a composition using any of the above techniques (e.g. analytical spectroscopy techniques). The melting temperature is the temperature at the midpoint of a thermal transition curve wherein 50% of molecules of a composition are in a folded state (See e.g., Dimasi et al. (2009) J. Mol Biol. 393: 672-692). In one embodiment, Tm values for a CD123 binding domain, e.g., scFv are about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an IgG is about 40° C., 41° C., 42° C., 43° C., 44° C., 45° C., 46° C., 47° C., 48° C., 49° C., 50° C., 51° C., 52°

C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an multivalent antibody is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C.

Thermal stability is also evaluated by measuring the specific heat or heat capacity (Cp) of a composition using an analytical calorimetric technique (e.g. DSC). The specific heat of a composition is the energy (e.g. in kcal/mol) is required to rise by 1° C., the temperature of 1 mol of water. As large Cp is a hallmark of a denatured or inactive protein composition. The change in heat capacity (ΔCp) of a composition is measured by determining the specific heat of a composition before and after its thermal transition. Thermal stability may also be evaluated by measuring or determining other parameters of thermodynamic stability including Gibbs free energy of unfolding (ΔG), enthalpy of unfolding (ΔH), or entropy of unfolding (ΔS). One or more of the above biochemical assays (e.g. a thermal challenge assay) are used to determine the temperature (i.e. the $T_C$ value) at which 50% of the composition retains its activity (e.g. binding activity).

In addition, mutations to the CD123 binding domain, e.g., scFv alter the thermal stability of the CD123 binding domain, e.g., scFv compared with the unmutated CD123 binding domain, e.g., scFv. When the humanized or human CD123 binding domain, e.g., scFv is incorporated into a CART123 construct, the CD123 binding domain, e.g., humanized or human scFv confers thermal stability to the overall CD123 CART construct. In one embodiment, the CD123 binding domain, e.g., scFv comprises a single mutation that confers thermal stability to the CD123 binding domain, e.g., scFv. In another embodiment, the CD123 binding domain, e.g., scFv comprises multiple mutations that confer thermal stability to the CD123 binding domain, e.g., scFv. In one embodiment, the multiple mutations in the CD123 binding domain, e.g., scFv have an additive effect on thermal stability of the CD123 binding domain, e.g., scFv.

b) % Aggregation

The stability of a composition can be determined by measuring its propensity to aggregate. Aggregation can be measured by a number of non-limiting biochemical or biophysical techniques. For example, the aggregation of a composition may be evaluated using chromatography, e.g. Size-Exclusion Chromatography (SEC). SEC separates molecules on the basis of size. A column is filled with semi-solid beads of a polymeric gel that will admit ions and small molecules into their interior but not large ones. When a protein composition is applied to the top of the column, the compact folded proteins (i.e. non-aggregated proteins) are distributed through a larger volume of solvent than is available to the large protein aggregates. Consequently, the large aggregates move more rapidly through the column, and in this way the mixture can be separated or fractionated into its components. Each fraction can be separately quantified (e.g. by light scattering) as it elutes from the gel. Accordingly, the % aggregation of a composition can be determined by comparing the concentration of a fraction with the total concentration of protein applied to the gel. Stable compositions elute from the column as essentially a single fraction and appear as essentially a single peak in the elution profile or chromatogram.

c) Binding Affinity

The stability of a composition can be assessed by determining its target binding affinity. A wide variety of methods for determining binding affinity are known in the art. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991) Biotechniques 11:620-627; Johnsson, B., et al. (1995) J. Mol. Recognit. 8:125-131; and Johnnson, B., et al. (1991) Anal. Biochem. 198:268-277.

In one aspect, the antigen binding domain of the CAR comprises an amino acid sequence that is homologous to an antigen binding domain amino acid sequence described herein, and the antigen binding domain retains the desired functional properties of the CD123 antibody fragments described herein. In one specific aspect, the CAR composition of the invention comprises an antibody fragment. In a further aspect, that antibody fragment comprises an scFv.

In various aspects, the antigen binding domain of the CAR is engineered by modifying one or more amino acids within one or both variable regions (e.g., VH and/or VL), for example within one or more CDR regions and/or within one or more framework regions. In one specific aspect, the CAR composition of the invention comprises an antibody fragment. In a further aspect, that antibody fragment comprises an scFv.

It will be understood by one of ordinary skill in the art that the antibody or antibody fragment of the invention may further be modified such that they vary in amino acid sequence (e.g., from wild-type), but not in desired activity. For example, additional nucleotide substitutions leading to amino acid substitutions at "non-essential" amino acid residues may be made to the protein For example, a nonessential amino acid residue in a molecule may be replaced with another amino acid residue from the same side chain family. In another embodiment, a string of amino acids can be replaced with a structurally similar string that differs in order and/or composition of side chain family members, e.g., a conservative substitution, in which an amino acid residue is replaced with an amino acid residue having a similar side chain, may be made.

Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

In one aspect, the present invention contemplates modifications of the starting antibody or fragment (e.g., scFv) amino acid sequence that generate functionally equivalent molecules. For example, the VH or VL of a CD123 binding domain, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the CD123 binding domain, e.g., scFv.

The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the CAR-expressing cell, e.g., CART cell, cell surface. In a different aspect the amino acid sequence of the transmembrane domain may be modified or substituted so as to minimize interactions with the binding domains of the native binding partner present in the same CAR-expressing cell, e.g., CART cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD3 epsilon, CD45, CD4, CD5, CD8 (e.g., CD8 alpha, CD8 beta), CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C, and CD19.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO:2. In one aspect, the transmembrane domain comprises (e.g., consists of) a transmembrane domain of SEQ ID NO: 6.

In one aspect, the hinge or spacer comprises an IgG4 hinge. For example, in one embodiment, the hinge or spacer comprises a hinge of the amino acid sequence ESKYGPP-CPPCPAPEFLGGPSVFLFPPKPKDTLMISRTPEVTCV-VVDVSQEDPEVQFNW YVDGVEVHNAKTKPREEQF-NSTYRVVSVLTVLHQDWLNGKEYKCKVSNKGLPS-SIEK TISKAKGQPREPQVYTLPPSQEEMTKNQVSLT-CLVKGFYPSDIAVEWESNGQPENNYK TTPPVLDS-DGSFFLYSRLTVDKSRWQEGNVFSCSVMHEALHN-HYTQKSLSLSLGKM (SEQ ID NO:3). In some embodiments, the hinge or spacer comprises a hinge encoded by a nucleotide sequence of GAGAGCAAG-TACGGCCCTCCCTGCCCCCCTTGCCCTGC-CCCCGAGTTCCTGGGCGG ACCCAGCGTGTTCCT-GTTCCCCCCCAAGCCCAAGGACACCCTGATGAT-CAGCCGGA CCCCCGAGGTGACCTGTGTGGTGGTG-GACGTGTCCCAGGAGGACCCCGAGGTCCA GTTCAACTGGTACGTGGACGGCGTGGAGGTGCA-CAACGCCAAGACCAAGCCCCGG GAGGAGCAGT-TCAATAGCACCTACCGGGTGGTGTCCGTGCTGAC-CGTGCTGCACCA GGACTGGCTGAACGGCAAGGAATACAAGTG-TAAGGTGTCCAACAAGGGCCTGCCC AGCAGCATC-GAGAAAACCATCAGCAAGGCCAAGGGCCAGC-CTCGGGAGCCCCAGG TGTACACCCTGCCCCCTAGCCAAGAGGAGATGAC-CAAGAACCAGGTGTCCCTGAC CTGCCTGGT-GAAGGGCTTCTACCCCAGCGACATCGCCGTG-GAGTGGGAGAGCAAC GGCCAGCCCGAGAACAACTACAAGACCAC-CCCCCCTGTGCTGGACAGCGACGGCA GCTTCTTC-CTGTACAGCCGGCTGACCGTGGACAAGAGCCG-GTGGCAGGAGGGCAA CGTCTTTAGCTGCTCCGTGATGCACGAGGCCCTG-CACAACCACTACACCCAGAAGA GCCTGAGCCT-GTCCCTGGGCAAGATG (SEQ ID NO:14).

In one aspect, the hinge or spacer comprises an IgD hinge. For example, in one embodiment, the hinge or spacer comprises a hinge of the amino acid sequence RWPESP-KAQASSVPTAQPQAEGSLAKATTAPATTRNTGRG-GEEKKKEKEKEEQEERET KTPECPSHTQPLGVYLLT-PAVQDLWLRDKATFTCFVVGSDLKDAHLTWEVA-GKVPTG GVEEGLLERHSNGSQSQHSRLTL-PRSLWNAGTSVTCTLNHPSLPPQRLMALREPAAQA PVKLSLNLLASSDPPEAASWLLCEVSGFSPPNILLM-WLED QREVNTSGFAPARPPPQPG STTFWAWSVLRV-PAPPSPQPATYTCVVSHEDSRTLL-NASRSLEVSYVTDH (SEQ ID NO:4). In some embodiments, the hinge or spacer comprises a hinge encoded by a nucleotide sequence of AGGTGGC-CCGAAAGTCCCAAGGCCCAGGCATCTAGTGTTC-CTACTGCACAGCCCCA GGCAGAAGGCAGCCTAGC-CAAAGCTACTACTGCACCTGCCACTACGCGCAATACT GGCCGTGGCGGGAGGAGGAAGAAAAAGGA-GAAAGAGAAAGAAGAACAGGAAGA GAGGGA-GACCAAGACCCCTGAATGTCCATCCCATACCCAGC-CGCTGGGCGTCTATC TCTTGACTCCCGCAGTACAGGACTTGTGGCTTAGA-GATAAGGCCACCTTTACATGT TTCGTCGTGGGCTCTGACCTGAAGGATGCCCATTT-GACTTGGGAGGTTGCCGGAAA GGTACCCACA-GGGGGGGTTGAGGAAGGGTTGCTGGAGCGCCAT-TCCAATGGCTCT CAGAGCCAGCACTCAAGACTCACCCTTCCGA-GATCCCTGTGGAACGCCGGGACCTC TGTCACATG-TACTCTAAATCATCCTAGCCTGCCCCCACAGCGTCT-GATGGCCCTTAG AGAGCCAGCCGCCCAGGCACCAGTTAAGCTTAGC-CTGAATCTGCTCGCCAGTAGTG ATCCCCCAGAG-GCCGCCAGCTGGCTCTTATGCGAAGTGTCCGGCTT-TAGCCCGCCC AACATCTTGCTCATGTGGCTGGAGGACCAGCGA-GAAGTGAACACCAGCGGCTTCG CTCCAGCCCGGC-CCCCACCCCAGCCGGGTTCTACCACATTCTGGGC-CTGGAGTGTC TTAAGGGTCCCAGCACCACCTAGCCCCCAGCCA-GCCACATACACCTGTGTTGTGTC CCATGAAGA-TAGCAGGACCCTGCTAAATGCTTCTAGGAGTCTG-GAGGTTTCCTACG TGACTGACCATT (SEQ ID NO:15).

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:5). In some embodiments, the linker is encoded by a nucleotide sequence of GGTG-GCGGAGGTTCTGGAGGTGGAGGTTCC (SEQ ID NO:16).

In one aspect, the hinge or spacer comprises a KIR2DS2 hinge.

Cytoplasmic Domain

The Cytoplasmic Domain or Region of the Present CAR Includes an Intracellular signaling domain. An intracellular signaling domain is capable of activation of at least one of the normal effector functions of the immune cell in which the CAR has been introduced.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Further examples of molecules containing a primary intracellular signaling domain that are of particular use in the invention include those of DAP10, DAP12, and CD32.

The intracellular signalling domain of the CAR can comprise the primary signalling domain, e.g., CD3-zeta signaling domain, by itself or it can be combined with any other desired intracellular signalling domain(s) useful in the context of a CAR of the invention. For example, the intracellular signaling domain of the CAR can comprise a primary signalling domain, e.g., CD3 zeta chain portion, and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. For example, CD27 costimulation has been demonstrated to enhance expansion, effector function, and survival of human CART cells in vitro and augments human T cell persistence and antitumor activity in vivo (Song et al. Blood. 2012; 119(3):696-706).

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 7. In one aspect, the signaling domain of CD3-zeta is a signaling domain of SEQ ID NO: 9 (mutant CD3-zeta) or SEQ ID NO: 10 (wild type human CD3-zeta).

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO:8). In one aspect, the signalling domain of CD27 is encoded by a nucleic acid sequence of AGGAGTAAGAGGAGCAGGCTCCTG-CACAGTGACTACATGAACATGACTCCCCGCC GCCCCGGGCCCACCCGCAAGCATTACCAGCCCTAT-GCCCCACCACGCGACTTCGCA GCCTATCGCTCC (SEQ ID NO:19).

In one aspect, the signaling domain of CD27 comprises an amino acid sequence of QRRKYRSNKGESPVEPAEPCRY-SCPREEEGSTIPIQEDYRKPEPACSP (SEQ ID NO:8).

In one aspect, the signalling domain of CD27 is encoded by a nucleic acid sequence of AGGAGTAAGAGGAGCA-GGCTCCTGCACAGTGACTACATGAACATGACTC-CCCGCC GCCCCGGGCCCACCCGCAAGCATTACCA-GCCCTATGCCCCACCACGCGACTTCGCA GCCTATCGCTCC (SEQ ID NO:19).

In one aspect, the intracellular is designed to comprise the signaling domain of CD3-zeta and the signaling domain of CD28. In one aspect, the signaling domain of CD28 comprises an amino acid sequence of SEQ ID NO: 379. In one aspect, the signaling domain of CD28 is encoded by a nucleic acid sequence of SEQ ID NO: 380.

In one aspect, the intracellular is designed to comprise the signaling domain of CD3-zeta and the signaling domain of ICOS. In one aspect, the signaling domain of CD28 comprises an amino acid sequence of SEQ ID NO: 381. In one aspect, the signaling domain of ICOS is encoded by a nucleic acid sequence of SEQ ID NO: 382.

In one aspect, the CAR-expressing cell described herein can further comprise a second CAR, e.g., a second CAR that includes a different antigen binding domain, e.g., to the same target (CD123) or a different target (e.g., CD19, CD33, CLL-1, CD34, FLT3, or folate receptor beta). In one embodiment, the second CAR includes an antigen binding domain to a target expressed on acute myeloid leukemia cells, such as, e.g., CD19, CD33, CLL-1, CD34, FLT3, or folate receptor beta. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27, ICOS or OX-40, onto the first CAR, and the primary signaling domain, e.g., CD3 zeta, on the second CAR can limit the CAR activity to cells where both targets are expressed. In one embodiment, the CAR expressing cell comprises a first CD123 CAR that includes a CD123 binding domain, a transmembrane domain and a costimulatory domain and a second CAR that targets an antigen other than CD123 (e.g., an antigen expressed on AML cells, e.g., CD19, CD33, CLL-1, CD34, FLT3, or folate receptor beta) and includes an antigen binding domain, a transmembrane domain and a primary signaling domain. In another embodiment, the CAR expressing cell comprises a first CD123 CAR that includes a CD123 binding domain, a transmembrane domain and a primary signaling domain and a second CAR that targets an antigen other than CD123 (e.g., an antigen expressed on AML cells, e.g., CD19, CD33, CLL-1, CD34, FLT3, or folate receptor beta) and includes an antigen binding domain to the antigen, a transmembrane domain and a costimulatory signaling domain.

In one embodiment, the CAR-expressing cell comprises a CD123 CAR described herein and an inhibitory CAR. In one embodiment, the inhibitory CAR comprises an antigen binding domain that binds an antigen found on normal cells but not cancer cells, e.g., normal cells that also express CD123. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta).

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising a antigen binding domains that minimize such interactions, as well as methods of making and using such cells and nucleic acids. In an embodiment the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

In some embodiments, the antigen binding domain of one of said first CAR said second CAR comprises an scFv, and the other comprises a single VH domain, e.g., a camelid, shark, or lamprey single VH domain, or a single VH domain derived from a human or mouse sequence. In some embodiments, the antigen binding domain of one of said first CAR said second CAR comprises an scFv, and the other comprises a nanobody. In some embodiments, the antigen binding domain of one of said first CAR said second CAR comprises an scFv, and the other comprises a camelid VHH domain.

In some embodiments, when present on the surface of a cell, binding of the antigen binding domain of said first CAR to its cognate antigen is not substantially reduced by the presence of said second CAR. In some embodiments, binding of the antigen binding domain of said first CAR to its cognate antigen in the presence of said second CAR is 85%, 90%, 95%, 96%, 97%, 98% or 99% of binding of the antigen binding domain of said first CAR to its cognate antigen in the absence of said second CAR.

In some embodiments, when present on the surface of a cell, the antigen binding domains of said first CAR said second CAR, associate with one another less than if both were scFv antigen binding domains. In some embodiments, the antigen binding domains of said first CAR said second CAR, associate with one another 85%, 90%, 95%, 96%, 97%, 98% or 99% less than if both were scFv antigen binding domains.

In another aspect, the CAR-expressing cell described herein can further express another agent, e.g., an agent which enhances the activity of a CAR-expressing cell. For example, in one embodiment, the agent can be an agent which inhibits an inhibitory molecule. Inhibitory molecules, e.g., PD1, can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta). In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta), or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). In embodiments, the CAR-expressing cell described herein comprises a switch costimulatory receptor, e.g., as described in WO 2013/019615, which is incorporated herein by reference in its entirety. PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with a CD123 CAR described herein, improves the persistence of the CAR-expressing cell, e.g., T cell or NK cell. In one embodiment, the CAR is a PD1 CAR comprising the extracellular domain of PD1 indicated as underlined in SEQ ID NO: 24. In one embodiment, the PD1 CAR comprises the amino acid sequence of SEQ ID NO:24.

(SEQ ID NO: 24)
Malpvtalllplalllhaarppqwfldspdrpwnpptfspallvvteqdn atftcsfsntsesfvlnwyrmspsnqtdklaafpedrsqpgqdcrfrvtq lpngrdfhmsvvrarrndsqtylcqaislapkaqikeslraelrvterra evptahpspsprpagqfqtlvttttpaprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr.

In one embodiment, the PD1 CAR comprises the amino acid sequence provided below (SEQ ID NO:22).

(SEQ ID NO: 22)
pqwfldspdrpwnpptfspallvvteqdnatftcsfsntsesfvlnwyrm spsnqtdklaafpedrsqpgqdcrfrvtqlpngrdfhmsvvrarrndsgt ylcqaislapkaqikeslraelryterraevptahpspsprpagqfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr.

In one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 23

(SEQ ID NO: 23)
atggccctccctgtcactgccctgcttctccccctcgcactcctgctcca cgccgctagacca<u>cccggatggtttctggactctccggatcgcccgtgga</u>

<u>atcccccaaccttctcaccggcactcttggttgtgactgagggcgataat</u>

```
gcgaccttcacgtgctcgttctccaacacctccgaatcattcgtgctgaa ctggtaccgcatgagcccgtcaaaccagaccgacaagctcgccgcgtttc cggaagatcggtcgcaaccgggacaggattgtcggttccgcgtgactcaa ctgccgaatggcagagacttccacatgagcgtggtccgcgctaggcgaaa cgactccgggacctacctgtgcggagccatctcgctggcgcctaaggccc aaatcaaagagagcttgagggccgaactgagagtgaccgagcgcagagct gaggtgccaactgcacatccatcccatcgcctcggcctgcgggcagtt tcagaccctggtcacgaccactccggcgccgcgccaccgactccggccc caactatcgcgagccagccctgtcgctgaggccggaagcatgccgccct gccgccggaggtgctgtgcataccegggggattggacttcgcatgcgacat ctacatttgggctcctctcgccggaacttgtggcgtgctccttctgtccc tggtcatcaccctgtactgcaagcggggtcggaaaaagcttctgtacatt ttcaagcagcccttcatgaggcccgtgcaaaccacccaggaggaggacgg ttgctcctgccggttccccgaagaggaagaaggaggttgcgagctgcgcg tgaagttctcccggagcgccgacgccccgcctataagcagggccagaac cagctgtacaacgaactgaacctgggacggcgggaagagtacgatgtgct ggacaagcggcgcggccgggaccccgaaatgggcgggaagcctagaagaa agaaccctcaggaaggcctgtataacgagctgcagaaggacaagatggcc gaggcctactccgaaattgggatgaagggagagcggcggaggggaaaggg gcacgacggcctgtaccaaggactgtccaccgccaccaaggacacatacg atgccctgcacatgcaggcccttccccctcgc.
```

In another aspect, the present invention provides a population of CAR-expressing cells, e.g., CART cells or CAR-expressing NK cells. In some embodiments, the population of CAR-expressing cells comprises a mixture of cells expressing different CARs. For example, in one embodiment, the population of CAR-expressing cells (e.g., CART cells or CAR-expressing NK cells) can include a first cell expressing a CAR having a CD123 binding domain described herein, and a second cell expressing a CAR having a different CD123 binding domain, e.g., a CD123 binding domain described herein that differs from the CD123 binding domain in the CAR expressed by the first cell. As another example, the population of CAR-expressing cells can include a first cell expressing a CAR that includes a CD123 binding domain, e.g., as described herein, and a second cell expressing a CAR that includes an antigen binding domain to a target other than CD123 (e.g., CD33, CD34, CLL-1, FLT3, or folate receptor beta). In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present invention provides a population of cells wherein at least one cell in the population expresses a CAR having a CD123 domain described herein, and a second cell expressing another agent, e.g., an agent which enhances the activity of a CAR-expressing cell. For example, in one embodiment, the agent can be an agent which inhibits an inhibitory molecule. Inhibitory molecules, e.g., can, in some embodiments, decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta). In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR (e.g., TGFR beta), or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one aspect, the present invention provides methods comprising administering a population of CAR-expressing cells, e.g., CART cells or CAR-expressing NK cells, e.g., a mixture of cells expressing different CARs, in combination with another agent, e.g., a kinase inhibitor, such as a kinase inhibitor described herein. In another aspect, the present invention provides methods comprising administering a population of cells wherein at least one cell in the population expresses a CAR having an anti-cancer associated antigen binding domain as described herein, and a second cell expressing another agent, e.g., an agent which enhances the activity of a CAR-expressing cell, in combination with another agent, e.g., a kinase inhibitor, such as a kinase inhibitor described herein.

Natural Killer Cell Receptor (NKR) CARs

In an embodiment, the CAR molecule described herein comprises one or more components of a natural killer cell receptor (NKR), thereby forming an NKR-CAR. The NKR component can be a transmembrane domain, a hinge domain, or a cytoplasmic domain from any of the following natural killer cell receptors: killer cell immunoglobulin-like receptor (KIR), e.g., KIR2DL1, KIR2DL2/L3, KIR2DL4, KIR2DL5A, KIR2DL5B, KIR2DS1, KIR2DS2, KIR2DS3, KIR2DS4, DIR2DS5, KIR3DL1/S1, KIR3DL2, KIR3DL3, KIR2DP1, and KIR3DP1; natural cyotoxicity receptor (NCR), e.g., NKp30, NKp44, NKp46; signaling lymphocyte activation molecule (SLAM) family of immune cell receptors, e.g., CD48, CD229, 2B4, CD84, NTB-A, CRACC, BLAME, and CD2F-10; Fc receptor (FcR), e.g., CD16, and CD64; and Ly49 receptors, e.g., LY49A, LY49C. The NKR-CAR molecules described herein may interact with an adaptor molecule or intracellular signaling domain, e.g., DAP12. Exemplary configurations and sequences of CAR molecules comprising NKR components are described in International Publication No. WO2014/145252, the contents of which are hereby incorporated by reference.

Split CAR

In some embodiments, the CAR-expressing cell uses a split CAR. The split CAR approach is described in more detail in publications WO2014/055442 and WO2014/055657, incorporated herein by reference. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens. In embodiments the first antigen binding domain recognizes CD123, e.g., comprises an antigen binding domain described herein, and the second antigen binding domain recognizes an antigen expressed on acute myeloid leukemia cells, e.g., CLL-1, CD33, CD34, FLT3, or folate receptor beta. In embodiments the first antigen binding domain recognizes CD123, e.g., comprises an antigen binding domain described herein, and the second antigen binding domain recognizes an antigen expressed on B-cells, e.g., CD19, CD20, CD22 or ROR1.

Strategies for Regulating Chimeric Antigen Receptors

There are many ways CAR activities can be regulated. In some embodiments, a regulatable CAR (RCAR) where the CAR activity canbe controlled is desirable to optimize the safety and efficacy of a CAR therapy. For example, inducing apoptosis using, e.g., a caspase fused to a dimerization domain (see, e.g., Di et al., N Engl. J. Med. 2011 Nov. 3; 365(18):1673-1683), can be used as a safety switch in the CAR therapy of the instant invention. In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or complement-induced cell death. For example, CAR expressing cells described herein may also express a receptor capable of being targeted by an antibody or antibody fragment. Examples of such receptors include EpCAM, VEGFR, integrins (e.g., integrins αvβ3, α4, αI¾β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD1 1, CD1 1 a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain).

For example, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g, ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab, as described in the Examples herein.

In other embodiments, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. Additional description and exemplary configurations of such regulatable CARs are provided herein and in International Publication No. WO 2015/090229, hereby incorporated by reference in its entirety.

In an aspect, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that specifically binds a tumor antigen described herein, as described herein and a second switch domain. Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 4-1BB, CD28, CD27, ICOS, and OX40, and in embodiments, no primary intracellular signaling domain. In an embodiment, the antigen binding member comprises the following costimulatory signaling domains, from the extracellular to intracellular direction: 4-1BB-CD27; 4-1BB-CD27; CD27-4-1BB; 4-1BB-CD28; CD28-4-1BB; OX40-CD28; CD28-OX40; CD28-4-1BB; or 4-1BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 4-1BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB,-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) *Identification of an 11-kDa FKBP12-rapamycin-binding domain within the 289-kDa FKBP12-rapamycin-associated protein and characterization of a critical serine residue*. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

(SEQ ID NO: 588)
D V P D Y A S L G G P S S P K K K R K V S R G V Q

V E T I S P G D G R T F P K R G Q T C V V H Y T G

M L E D G K K F D S S R D R N K P F K F M L G K Q

E V I R G W E E G V A Q M S V G Q R A K L T I S P

D Y A Y G A T G H P G I I P P H A T L V F D V E L

L K L E T S Y

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 588, which is:

(SEQ ID NO: 589)
V Q V E T I S P G D G R T F P K R G Q T C V V H Y

T G M L E D G K K F D S S R D R N K P F K F M L G

K Q E V I R G W E E G V A Q M S V G Q R A K L T I

S P D Y A Y G A T G H P G I I P P H A T L V F D V

E L L K L E T S

The amino acid sequence of FRB is as follows:

(SEQ ID NO: 590)
ILWHEMWHEG LEEASRLYFG ERNVKGMFEV LEPLHAMMER

GPQTLKETSF NQAYGRDLME AQEWCRKYMK SGNVKDLTQA

WDLYYHVFRR ISK

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 54 or 55; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 56. In an embodiment, a RCAR described herein comprises one switch domain comprises amino acid residues disclosed in SEQ ID NO: 588 (or SEQ ID NO: 589), and one switch domain comprises amino acid residues disclosed in SEQ ID NO: 590.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, 52035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 591, or leucine (E2032L), e.g., SEQ ID NO: 592. In an embodiment, a mutant FRB comprises a mutation at T2098, where T2098 is mutated to phenylalanine (T2098F) or leucine (T2098L), e.g., SEQ ID NO: 593. In an embodiment, a mutant FRB comprises a mutation at E2032 and at T2098, where E2032 is mutated to any amino acid, and where T2098 is mutated to any amino acid, e.g., SEQ ID NO: 594. In an embodiment, a mutant FRB comprises an E2032I and a T2098L mutation, e.g., SEQ ID NO: 595. In an embodiment, a mutant FRB comprises an E2032L and a T2098L mutation, e.g., SEQ ID NO: 596.

TABLE 14

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHA MMERGPQTLKETSFNQAYGRDLMEAQEWCRKYMKSG NVKDLTQAWDLYYHVFRRISKTS | 591 |
| E2032L mutant | ILWHEMWHEGLLEASRLYFGERNVKGMFEVLEPLHA MMERGPQTLKETSFNQAYGRDLMEAQEWCRKYMKSG NVKDLTQAWDLYYHVFRRISKTS | 592 |
| T2098L mutant | ILWHEMWHEGLEEASRLYFGERNVKGMFEVLEPLHA MMERGPQTLKETSFNQAYGRDLMEAQEWCRKYMKSG NVKDLLQAWDLYYHVFRRISKTS | 593 |
| E2032, T2098 mutant | ILWHEMWHEGLXEASRLYFGERNVKGMFEVLEPLHA MMERGPQTLKETSFNQAYGRDLMEAQEWCRKYMKSG NVKDLXQAWDLYYHVFRRISKTS | 594 |
| E2032I, T2098L mutant | ILWHEMWHEGLIEASRLYFGERNVKGMFEVLEPLHA MMERGPQTLKETSFNQAYGRDLMEAQEWCRKYMKSG NVKDLLQAWDLYYHVFRRISKTS | 595 |
| E2032L, T2098L mutant | ILWHEMWHEGLLEASRLYFGERNVKGMFEVLEPLHA MMERGPQTLKETSFNQAYGRDLMEAQEWCRKYMKSG NVKDLLQAWDLYYHVFRRISKTS | 596 |

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Combination with a low dose mTOR inhibitor".

Co-expression of CAR with a Chemokine Receptor

In embodiments, the CAR-expressing cell described herein further comprises a chemokine receptor molecule. Transgenic expression of chemokine receptors CCR2b or CXCR2 in T cells enhances trafficking to CCL2- or CXCL1-secreting solid tumors including melanoma and neuroblastoma (Craddock et al., *J Immunother.* 2010 October; 33(8): 780-8 and Kershaw et al., *Hum Gene Ther.* 2002 Nov. 1; 13(16):1971-80). Thus, without wishing to be bound by theory, it is believed that chemokine receptors expressed in CAR-expressing cells that recognize chemokines secreted by tumors, e.g., solid tumors, can improve homing of the CAR-expressing cell to the tumor, facilitate the infiltration of the CAR-expressing cell to the tumor, and enhances antitumor efficacy of the CAR-expressing cell. The chemokine receptor molecule can comprise a naturally occurring or recombinant chemokine receptor or a chemokine-binding fragment thereof. A chemokine receptor molecule suitable for expression in a CAR-expressing cell described herein include a CXC chemokine receptor (e.g., CXCR1, CXCR2, CXCR3, CXCR4, CXCR5, CXCR6, or CXCR7), a CC chemokine receptor (e.g., CCR1, CCR2, CCR3, CCR4, CCR5, CCR6, CCR7, CCR8, CCR9, CCR10, or CCR11), a CX3C chemokine receptor (e.g., CX3CR1), a XC chemokine receptor (e.g., XCR1), or a chemokine-binding fragment thereof. In one embodiment, the chemokine receptor molecule to be expressed with a CAR described herein is selected based on the chemokine(s) secreted by the tumor. In one embodiment, the CAR-expressing cell described herein further comprises, e.g., expresses, a CCR2b receptor or a CXCR2 receptor. In an embodiment, the CAR described herein and the chemokine receptor molecule are on the same vector or are on two different vectors. In embodiments where the CAR described herein and the chemokine receptor molecule are on the same vector, the CAR and the chemokine receptor molecule are each under control of two different promoters or are under the control of the same promoter.

RNA Transfection

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:35). RNA so produced can efficiently transfect different kinds of cells. In one aspect, the template includes sequences for the CAR.

In one aspect the CD123 CAR is encoded by a messenger RNA (mRNA). In one aspect the mRNA encoding the CD123 CAR is introduced into a T cell for production of a CART cell.

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR of the present invention. For example, the template for the RNA CAR comprises an extracellular region comprising a single chain variable domain of an anti-tumor antibody; a hinge region, a transmembrane domain (e.g., a transmembrane domain of CD8a); and a cytoplasmic region that includes an intracellular signaling domain, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 31) (size can be 50-5000 T (SEQ ID NO: 32)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 33).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 34) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

Accordingly, in one aspect, the invention pertains to an isolated nucleic acid molecule encoding a chimeric antigen receptor (CAR), wherein the CAR comprises a CD123 binding domain (e.g., a humanized or human CD123 binding domain), a transmembrane domain, and an intracellular signaling domain comprising a stimulatory domain, e.g., a costimulatory signaling domain and/or a primary signaling domain, e.g., zeta chain. In one embodiment, the CD123 binding domain is a CD123 binding domain described herein, e.g., an CD123 binding domain which comprises a sequence selected from a group consisting of SEQ ID NO: 157-160, 184-215, 478, 480, 483, 485, and 556-587, or a sequence with 95-99% identity thereof. In one embodiment, the CD123 binding domain comprises a human CD123 binding domain which comprises a sequence selected from a group consisting of SEQ ID NO: 157-160, 478, 480, 483, and 485. In one embodiment, the CD123 binding domain comprises a humanized CD123 binding domain which comprises a sequence selected from a group consisting of SEQ ID NO: 184-215, and 556-587. In one embodiment, the transmembrane domain is transmembrane domain of a protein, e.g., described herein, e.g., selected from the group consisting of the alpha, beta or zeta chain of the T-cell receptor, CD28, CD3 epsilon, CD45, CD4, CDS, CD8, CD9, CD16, CD22, CD33, CD37, CD64, CD80, CD86, CD134, CD137 and CD154. In one embodiment, the transmembrane domain comprises a sequence of SEQ ID NO: 6, or a sequence with 95-99% identity thereof. In one embodiment, the CD123 binding domain is connected to the transmembrane domain by a hinge region, e.g., a hinge described herein. In one embodiment, the hinge region comprises SEQ ID NO:2 or SEQ ID NO:3 or SEQ ID NO:4 or SEQ ID NO:5, or a sequence with 95-99% identity thereof. In one embodiment, the isolated nucleic acid molecule further comprises a sequence encoding a costimulatory domain. In one embodiment, the costimulatory domain is a functional signaling domain of a protein, e.g., described herein, e.g., selected from the group consisting of a MHC class I molecule, a TNF receptor protein, an Immunoglobulin-like protein, a cytokine receptor, an integrin, a signaling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In one embodiment, the costimulatory domain comprises a sequence of SEQ ID NO:7, or a sequence with 95-99% identity thereof. In one embodiment, the intracellular signaling domain comprises a functional signaling domain of 4-1BB and a functional signaling domain of CD3 zeta. In one embodiment, the intracellular signaling domain comprises the sequence of SEQ ID NO: 7 or SEQ ID NO:8, or a sequence with 95-99% identity thereof, and the sequence of SEQ ID NO: 9 or SEQ ID NO:10, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a CAR construct comprising a leader sequence of SEQ ID NO: 1, a scFv domain having a sequence selected from the group consisting of SEQ ID NOS: 157-160, 184-215, 478, 480, 483, 485, and 556-587, (or a sequence with 95-99% identity thereof), a hinge region of SEQ ID NO:2 or SEQ ID NO:3 or SEQ ID NO:4 or SEQ ID NO:5 (or a sequence with 95-99% identity thereof), a transmembrane domain having a sequence of SEQ ID NO: 6 (or a sequence with 95-99% identity thereof), a 4-1BB costimulatory domain having a sequence of SEQ ID NO:7 or a CD27 costimulatory domain having a sequence of SEQ ID NO:8 (or a sequence with 95-99% identity thereof,) or a CD28 costimulatory domain having a sequence of SEQ ID NO:43 (or a sequence with 95-99% identity thereof) or a ICOS costimulatory domain having a sequence of SEQ ID NO: 45 (or a sequence with 95-99% identity thereof), and a CD3 zeta stimulatory domain having a sequence of SEQ ID NO:9 or SEQ ID NO:10 (or a sequence with 95-99% identity thereof).

In another aspect, the invention pertains to an isolated polypeptide molecule encoded by the nucleic acid molecule. In one embodiment, the isolated polypeptide molecule comprises a sequence selected from the group consisting of SEQ ID NO:98-101 and 125-156, or a sequence with 95-99% identity thereof.

In another aspect, the invention pertains to a nucleic acid molecule encoding a chimeric antigen receptor (CAR) molecule that comprises a CD123 binding domain, a transmembrane domain, and an intracellular signaling domain comprising a stimulatory domain, and wherein said CD123 binding domain comprises a sequence selected from the group consisting of SEQ ID NO: 157-160, 184-215, 478, 480, 483, 485, and 556-587, or a sequence with 95-99% identity thereof. In one embodiment, the CD123 binding domain comprises a human CD123 binding domain comprising a sequence selected from the group consisting of SEQ ID NO: 157-160, 478, 480, 483, and 485, or a sequence with 95-99% identity thereof. In one embodiment, the CD123 binding domain comprises a humanized CD123 binding domain comprising a sequence selected from the group consisting of SEQ ID NO: 184-215, and 556-587, or a sequence with 95-99% identity thereof.

In one embodiment, the encoded CAR molecule further comprises a sequence encoding a costimulatory domain. In one embodiment, the costimulatory domain is a functional signaling domain of a protein selected from the group consisting of a MHC class I molecule, a TNF receptor protein, an Immunoglobulin-like protein, a cytokine receptor, an integrin, a signaling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83. In one embodiment, the costimulatory domain comprises a sequence of SEQ ID NO:7.

In one embodiment, the transmembrane domain is a transmembrane domain of a protein selected from the group consisting of the alpha, beta or zeta chain of the T-cell receptor, CD28, CD3 epsilon, CD45, CD4, CDS, CD8, CD9, CD16, CD22, CD33, CD37, CD64, CD80, CD86, CD134, CD137, CD154, a MHC class I molecule, a TNF receptor protein, an Immunoglobulin-like protein, a cytokine receptor, an integrin, a signaling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

In one embodiment, the transmembrane domain comprises a sequence of SEQ ID NO:6. In one embodiment, the intracellular signaling domain comprises a functional signaling domain of 4-1BB and a functional signaling domain of zeta. In one embodiment, the intracellular signaling domain comprises the sequence of SEQ ID NO: 7 and the sequence of SEQ ID NO: 9, wherein the sequences comprising the intracellular signaling domain are expressed in the same frame and as a single polypeptide chain. In one embodiment, the CD123 binding domain is connected to the transmembrane domain by a hinge region. In one embodiment, the hinge region comprises SEQ ID NO:2. In one embodiment, the hinge region comprises SEQ ID NO:3 or SEQ ID NO:4 or SEQ ID NO:5.

In another aspect, the invention pertains to an encoded CAR molecule comprising a leader sequence of SEQ ID NO: 1, a scFv domain having a sequence selected from the group consisting of SEQ ID NO: 157-160, 184-215, 478, 480, 483, 485, 556-587, or a sequence with 95-99% identity thereof, a hinge region of SEQ ID NO:2 or SEQ ID NO:3 or SEQ ID NO:4 or SEQ ID NO:5, a transmembrane domain having a sequence of SEQ ID NO: 6, a 4-1BB costimulatory domain having a sequence of SEQ ID NO:7 or a CD27 costimulatory domain having a sequence of SEQ ID NO:8 or a CD28 costimulatory domain having a sequence of SEQ ID NO:43 or an ICOS costimulatory domain having a sequence of SEQ ID NO: 45, and a CD3 zeta stimulatory domain having a sequence of SEQ ID NO:9 or SEQ ID NO:10. In one embodiment, the encoded CAR molecule comprises a sequence selected from a group consisting of SEQ ID NO: 98-101 and 125-156, or a sequence with 95-99% identity thereof.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crisper, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

An example of a promoter that is capable of expressing a CAR transgene in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009). In one aspect, the EF1a promoter comprises the sequence provided as SEQ ID NO:11.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1a promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

```
WT PGK Promoter
                                                             (SEQ ID NO: 597)
ACCCCTCTCTCCAGCCACTAAGCCAGTTGCTCCCTCGGCTGACGGCTGCACGCGAGGCCTCCGAACGTCTTAC

GCCTTGTGGCGCGCCCGTCCTTGTCCCGGGTGTGATGGCGGGGTGTGGGCGGAGGGCGTGGCGGGGAAGGGC

CGGCGACGAGAGCCGCGCGGGACGACTCGTCGGCGATAACCGGTGTCGGGTAGCGCCAGCCGCGCGACGGTAA

CGAGGGACCGCGACAGGCAGACGCTCCCATGATCACTCTGCACGCCGAAGGCAAATAGTGCAGGCCGTGCGGC

GCTTGGCGTTCCTTGGAAGGGCTGAATCCCCGCCTCGTCCTTCGCAGCGGCCCCCGGGTGTTCCCATCGCCG

CTTCTAGGCCCACTGCGACGCTTGCCTGCACTTCTTACACGCTCTGGGTCCCAGCCGCGGCGACGCAAAGGGC

CTTGGTGCGGGTCTCGTCGGCGCAGGGACGCGTTTGGGTCCCGACGGAACCTTTTCCGCGTTGGGGTTGGGGC

ACCATAAGCT

Exemplary truncated PGK Promoters:
PGK100:
                                                             (SEQ ID NO: 598)
ACCCCTCTCTCCAGCCACTAAGCCAGTTGCTCCCTCGGCTGACGGCTGCACGCGAGGCCTCCGAACGTCTTAC

GCCTTGTGGCGCGCCCGTCCTTGTCCCGGGTGTGATGGCGGGGTG
```

```
PGK200:
                                                            (SEQ ID NO: 599)
ACCCCTCTCTCCAGCCACTAAGCCAGTTGCTCCCTCGGCTGACGGCTGCACGCGAGGCCTCCGAACGTCTTAC

GCCTTGTGGCGCGCCCGTCCTTGTCCCGGGTGTGATGGCGGGGTGTGGGCGGAGGGCGTGGCGGGGAAGGGC

CGGCGACGAGAGCCGCGCGGGACGACTCGTCGGCGATAACCGGTGTCGGGTAGCGCCAGCCGCGCGACGGTAA

CG

PGK300:
                                                            (SEQ ID NO: 600)
ACCCCTCTCTCCAGCCACTAAGCCAGTTGCTCCCTCGGCTGACGGCTGCACGCGAGGCCTCCGAACGTCTTAC

GCCTTGTGGCGCGCCCGTCCTTGTCCCGGGTGTGATGGCGGGGTGTGGGCGGAGGGCGTGGCGGGGAAGGGC

CGGCGACGAGAGCCGCGCGGGACGACTCGTCGGCGATAACCGGTGTCGGGTAGCGCCAGCCGCGCGACGGTAA

CGAGGGACCGCGACAGGCAGACGCTCCCATGATCACTCTGCACGCCGAAGGCAAATAGTGCAGGCCGTGCGGC

GCTTGGCGTTCCTTGGAAGGGCTGAATCCCCG

PGK400:
                                                            (SEQ ID NO: 601)
ACCCCTCTCTCCAGCCACTAAGCCAGTTGCTCCCTCGGCTGACGGCTGCACGCGAGGCCTCCGAACGTCTTAC

GCCTTGTGGCGCGCCCGTCCTTGTCCCGGGTGTGATGGCGGGGTGTGGGCGGAGGGCGTGGCGGGGAAGGGC

CGGCGACGAGAGCCGCGCGGGACGACTCGTCGGCGATAACCGGTGTCGGGTAGCGCCAGCCGCGCGACGGTAA

CGAGGGACCGCGACAGGCAGACGCTCCCATGATCACTCTGCACGCCGAAGGCAAATAGTGCAGGCCGTGCGGC

GCTTGGCGTTCCTTGGAAGGGCTGAATCCCCGCCTCGTCCTTCGCAGCGGCCCCCGGGTGTTCCCATCGCCG

CTTCTAGGCCCACTGCGACGCTTGCCTGCACTTCTTACACGCTCTGGGTCCCAGCCG
```

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In one embodiment, the vector can further comprise a nucleic acid encoding a second CAR. In one embodiment, the second CAR includes an antigen binding domain to a target expressed on acute myeloid leukemia cells, such as, e.g., CD33, CD34, CLL-1, FLT3, or folate receptor beta. In one embodiment, the vector comprises a nucleic acid sequence encoding a first CAR that targets a first antigen and includes an intracellular signaling domain having a costimulatory signaling domain but not a primary signaling domain, and a nucleic acid encoding a second CAR that targets a second, different, antigen and includes an intracellular signaling domain having a primary signaling domain but not a costimulatory signaling domain. In one embodiment, the vector comprises a nucleic acid encoding a first CD123 CAR that includes a CD123 binding domain, a transmembrane domain and a costimulatory domain and a nucleic acid encoding a second CAR that targets an antigen other than CD123 (e.g., an antigen expressed on AML cells, e.g., CD33, CD34, CLL-1, FLT3, or folate receptor beta) and includes an antigen binding domain, a transmembrane domain and a primary signaling domain. In another embodiment, the vector comprises a nucleic acid encoding a first CD123 CAR that includes a CD123 binding domain, a transmembrane domain and a primary signaling domain and a nucleic acid encoding a second CAR that targets an antigen other than CD123 (e.g., an antigen expressed on AML cells, e.g., CD33, CLL-1, CD34, FLT3, or folate receptor beta) and includes an antigen binding domain to the antigen, a transmembrane domain and a costimulatory signaling domain.

In one embodiment, the vector comprises a nucleic acid encoding a CD123 CAR described herein and a nucleic acid encoding an inhibitory CAR. In one embodiment, the inhibitory CAR comprises an antigen binding domain that binds an antigen found on normal cells but not cancer cells, e.g., normal cells that also express CD123. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta.

In embodiments, the vector may comprise two or more nucleic acid sequences encoding a CAR, e.g., a CD123 CAR described herein and a second CAR, e.g., an inhibitory CAR or a CAR that specifically binds to an antigen other than CD123 (e.g., an antigen expressed on AML cells, e.g., CLL-1, CD33, CD34, FLT3, or folate receptor beta). In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites. (e.g., an auto-cleavage site or a substrate for an intracellular protease). Examples of peptide cleavage sites include the following, wherein the GSG residues are optional:

T2A:
(SEQ ID NO: 602)
(GSG) E G R G S L L T C G D V E E N P G P

P2A:
(SEQ ID NO: 603)
(GSG) A T N F S L L K Q A G D V E E N P G

PE2A:
(SEQ ID NO: 604)
(GSG) Q C T N Y A L L K L A G D V E S N P G P

F2A:
(SEQ ID NO: 605)
(GSG) V K Q T L N F D L L K L A G D V E S N P G P

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., an immune effector cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian immune effector cells, e.g., mammalian T cells or mammalian NK cells. In one aspect, the mammalian T cell is a human T cell.

Sources of Cells

Prior to expansion and genetic modification, a source of cells (e.g., immune effector cells, e.g., T cells or NK cells), is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain aspects of the present invention, any number of immune effector cell (e.g., T cell or NK cell) lines available in the art, may be used. In certain aspects of the present invention, T cells can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and to place the cells in an appropriate buffer or media for subsequent processing steps. In one aspect of the invention, the cells are washed with phosphate buffered saline (PBS). In an alternative aspect, the wash solution lacks calcium and may lack magnesium or may lack many if not all divalent cations. Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as CD3+, CD28+, CD4+, CD8+, CD45RA+, and CD45RO+ T cells, can be further isolated by positive or negative selection techniques. For example, in one aspect, T cells are isolated by incubation with anti-CD3/anti-CD28 (e.g., 3×28)-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this invention. In certain aspects, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. In certain aspects, it may be desirable to enrich for or positively select for regulatory T cells which typically express CD4+, CD25+, CD62Lhi, GITR+, and FoxP3+. Alternatively, in certain aspects, T regulatory cells are depleted by anti-C25 conjugated beads or other similar method of selection.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 2 billion cells/ml is used. In one aspect, a concentration of 1 billion cells/ml is used. In a further aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is 5×10e6/ml. In other aspects, the concentration used can be from about $1 \times 10^5$/ml to $1 \times 10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as immune effector cells, e.g., T cells or NK cells, isolated and frozen for later use in T cell therapy for any number of diseases or conditions that would benefit from cell therapy, e.g., T cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the immune effector cells, e.g., T cells or NK cells, may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR Immune Effector Cells

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some aspects, downregulation of HLA may be accomplished by reducing or eliminating expression of beta-2 microglobulin (B2M).

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not expresses or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a cell.

Expression of siRNA and shRNAs in T cells can be achieved using any conventional expression system, e.g., such as a lentiviral expression system.

Exemplary shRNAs that downregulate expression of one or more components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Naturally-occurring CRISPR/Cas systems are found in approximately 40% of sequenced eubacteria genomes and 90% of sequenced archaea. Grissa et al. (2007) *BMC Bioinformatics* 8: 172. This system is a type of prokaryotic immune system that confers resistance to foreign genetic elements such as plasmids and phages and provides a form of acquired immunity. Barrangou et al. (2007) *Science* 315: 1709-1712; Marragini et al. (2008) Science 322: 1843-1845.

The CRISPR/Cas system has been modified for use in gene editing (silencing, enhancing or changing specific genes) in eukaryotes such as mice or primates. Wiedenheft et al. (2012) *Nature* 482: 331-8. This is accomplished by introducing into the eukaryotic cell a plasmid containing a specifically designed CRISPR and one or more appropriate Cas.

The CRISPR sequence, sometimes called a CRISPR locus, comprises alternating repeats and spacers. In a naturally-occurring CRISPR, the spacers usually comprise sequences foreign to the bacterium such as a plasmid or phage sequence; in the TCR and/or HLA CRISPR/Cas system, the spacers are derived from the TCR or HLA gene sequence.

RNA from the CRISPR locus is constitutively expressed and processed by Cas proteins into small RNAs. These comprise a spacer flanked by a repeat sequence. The RNAs guide other Cas proteins to silence exogenous genetic elements at the RNA or DNA level. Horvath et al. (2010) *Science* 327: 167-170; Makarova et al. (2006) *Biology Direct* 1: 7. The spacers thus serve as templates for RNA molecules, analogously to siRNAs. Pennisi (2013) *Science* 341: 833-836.

As these naturally occur in many different types of bacteria, the exact arrangements of the CRISPR and structure, function and number of Cas genes and their product differ somewhat from species to species. Haft et al. (2005) *PLoS Comput. Biol.* 1: e60; Kunin et al. (2007) *Genome Biol.* 8: R61; Mojica et al. (2005) *J. Mol. Evol.* 60: 174-182; Bolotin et al. (2005) *Microbiol.* 151: 2551-2561; Pourcel et al. (2005) *Microbiol.* 151: 653-663; and Stern et al. (2010) *Trends. Genet.* 28: 335-340. For example, the Cse (Cas subtype, *E. coli*) proteins (e.g., CasA) form a functional complex, Cascade, that processes CRISPR RNA transcripts into spacer-repeat units that Cascade retains. Brouns et al. (2008) *Science* 321: 960-964. In other prokaryotes, Cas6 processes the CRISPR transcript. The CRISPR-based phage inactivation in *E. coli* requires Cascade and Cas3, but not Cast or Cas2. The Cmr (Cas RAMP module) proteins in *Pyrococcus furiosus* and other prokaryotes form a functional complex with small CRISPR RNAs that recognizes and cleaves complementary target RNAs. A simpler CRISPR system relies on the protein Cas9, which is a nuclease with two active cutting sites, one for each strand of the double helix. Combining Cas9 and modified CRISPR locus RNA can be used in a system for gene editing. Pennisi (2013) *Science* 341: 833-836.

The CRISPR/Cas system can thus be used to edit a TCR and/or HLA gene (adding or deleting a basepair), or introducing a premature stop which thus decreases expression of a TCR and/or HLA. The CRISPR/Cas system can alternatively be used like RNA interference, turning off TCR and/or HLA gene in a reversible fashion. In a mammalian cell, for example, the RNA can guide the Cas protein to a TCR and/or HLA promoter, sterically blocking RNA polymerases.

Artificial CRISPR/Cas systems can be generated which inhibit TCR and/or HLA, using technology known in the art, e.g., that described in U.S. Publication No. 20140068797 and Cong (2013) Science 339: 819-823. Other artificial CRISPR/Cas systems that are known in the art may also be generated which inhibit TCR and/or HLA, e.g., that described in Tsai (2014) Nature Biotechnol., 32:6 569-576, U.S. Pat. Nos. 8,871,445; 8,865,406; 8,795,965; 8,771,945; and 8,697,359.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

TALENs are produced artificially by fusing a TAL effector DNA binding domain to a DNA cleavage domain. Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing. Boch (2011) *Nature Biotech*. 29: 135-6; and Boch et al. (2009) *Science* 326: 1509-12; Moscou et al. (2009) *Science* 326: 3501.

TALEs are proteins secreted by *Xanthomonas* bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is a wild-type or mutated FokI endonuclease. Several mutations to FokI have been made for its use in TALENs; these, for example, improve cleavage specificity or activity. Cermak et al. (2011) *Nucl. Acids Res.* 39: e82; Miller et al. (2011) *Nature Biotech*. 29: 143-8; Hockemeyer et al. (2011) *Nature Biotech*. 29: 731-734; Wood et al. (2011) *Science* 333: 307; Doyon et al. (2010) *Nature Methods* 8: 74-79; Szczepek et al. (2007) *Nature Biotech*. 25: 786-793; and Guo et al. (2010) *J. Mol. Biol.* 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) *Nature Biotech*. 29: 143-8.

A HLA or TCR TALEN can be used inside a cell to produce a double-stranded break (DSB). A mutation can be introduced at the break site if the repair mechanisms improperly repair the break via non-homologous end joining. For example, improper repair may introduce a frame shift mutation. Alternatively, foreign DNA can be introduced into the cell along with the TALEN; depending on the sequences of the foreign DNA and chromosomal sequence, this process can be used to correct a defect in the HLA or TCR gene or introduce such a defect into a wt HLA or TCR gene, thus decreasing expression of HLA or TCR.

TALENs specific to sequences in HLA or TCR can be constructed using any method known in the art, including various schemes using modular components. Zhang et al. (2011) *Nature Biotech.* 29: 149-53; Geibler et al. (2011) *PLoS ONE* 6: e19509.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) *Genetics Society of America* 188: 773-782; and Kim et al. (1996) *Proc. Natl. Acad. Sci. USA* 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) *Proc. Natl. Acad. Sci. USA* 95: 10570-5.

Also like a TALEN, a ZFN can create a double-stranded break in the DNA, which can create a frame-shift mutation if improperly repaired, leading to a decrease in the expression and amount of HLA and/or TCR in a cell. ZFNs can also be used with homologous recombination to mutate in the HLA or TCR gene.

ZFNs specific to sequences in HLA AND/OR TCR can be constructed using any method known in the art. Cathomen et al. (2008) *Mol. Ther.* 16: 1200-7; Guo et al. (2010) *J. Mol. Biol.* 400: 96; U.S. Patent Publication 2011/0158957; and U.S. Patent Publication 2012/0060230.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In one aspect, the disclosure features a method of making a population of immune effector cells (e.g., T cells, NK cells). In an embodiment, the method comprises: providing a population of immune effector cells (e.g., T cells or NK cells), contacting the population of immune effector cells with a nucleic acid encoding a CAR; and contacting the population of immune effector cells with a nucleic acid encoding a telomerase subunit, e.g., hTERT, under conditions that allow for CAR and telomerase expression.

In an embodiment, the nucleic acid encoding the telomerase subunit is DNA. In an embodiment, the nucleic acid encoding the telomerase subunit comprises a promoter capable of driving expression of the telomerase subunit.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795) as follows:

(SEQ ID NO: 606)
MPRAPRCRAVRSLLRSHYREVLPLATFVRRLGPQGWRLVQRGDPAAFRAL

VAQCLVCVPWDARPPPAAPSFRQVSCLKELVARVLQRLCERGAKNVLAFG

FALLDGARGGPPEAFTTSVRSYLPNTVTDALRGSGAWGLLLRRVGDDVLV

HLLARCALFVLVAPSCAYQVCGPPLYQLGAATQARPPPHASGPRRRLGCE

RAWNHSVREAGVPLGLPAPGARRRGGSASRSLPLPKRPRRGAAPEPERTP

VGQGSWAHPGRTRGPSDRGFCVVSPARPAEEATSLEGALSGTRHSHPSVG

RQHHAGPPSTSRPPRPWDTPCPPVYAETKHFLYSSGDKEQLRPSFLLSSL

RPSLTGARRLVETIFLGSRPWMPGTPRRLPRLPQRYWQMRPLFLELLGNH

AQCPYGVLLKTHCPLRAAVTPAAGVCAREKPQGSVAAPEEEDTDPRRLVQ

LLRQHSSPWQVYGFVRACLRRLVPPGLWGSRHNERRFLRNTKKFISLGKH

AKLSLQELTWKMSVRGCAWLRRSPGVGCVPAAEHRLREEILAKFLHWLMS

VYVVELLRSFFYVTETTFQKNRLFFYRKSVWSKLQSIGIRQHLKRVQLRE

LSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQ

DPPPELYFVKVDVTGAYDTIPQDRLTEVIASIIKPQNTYCVRRYAVVQKA

AHGHVRKAFKSHVSTLTDLQPYMRQFVAHLQETSPLRDAVVIEQSSSLNE

ASSGLFDVFLRFMCHHAVRIRGKSYVQCQGIPQGSILSTLLCSLCYGDME

NKLFAGIRRDGLLLRLVDDFLLVTPHLTHAKTFLRTLVRGVPEYGCVVNL

RKTVVNFPVEDEALGGTAFVQMPAHGLFPWCGLLLDTRTLEVQSDYSSYA

RTSIRASLTFNRGFKAGRNMRRKLFGVLRLKCHSLFLDLQVNSLQTVCTN

IYKILLLQAYRFHACVLQLPFHQQVWKNPTFFLRVISDTASLCYSILKAK

NAGMSLGAKGAAGPLPSEAVQWLCHQAFLLKLTRHRVTYVPLLGSLRTAQ

TQLSRKLPGTTLTALEAAANPALPSDFKTILD

In an embodiment, the hTERT has a sequence at least 80%, 85%, 90%, 95%, 96ˆ, 97%, 98%, or 99% identical to the sequence of SEQ ID NO: 606. In an embodiment, the hTERT has a sequence of SEQ ID NO: 606. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

```
                                                              (SEQ ID NO: 607)
   1 caggcagcgt ggtcctgctg cgcacgtggg aagccctggc cccggccacc cccgcgatgc
  61 cgcgcgctcc ccgctgccga gccgtgcgct ccctgctgcg cagccactac cgcgaggtgc
 121 tgccgctggc cacgttcgtg cggcgcctgg ggcccaggg ctggcggctg gtgcagcgcg
 181 gggacccggc ggctttccgc gcgctggtgg cccagtgcct ggtgtgcgtg ccctgggacg
 241 cacggccgcc ccccgccgcc ccctccttcc gccaggtgtc ctgcctgaag gagctggtgg
 301 cccgagtgct gcagaggctg tgcgagcgcg gcgcgaagaa cgtgctggcc ttcggcttcg
 361 cgctgctgga cggggcccgc gggggccccc ccgaggcctt caccaccagc gtgcgcagct
 421 acctgcccaa cacggtgacc gacgcactgc ggggagcgg ggcgtggggg ctgctgttgc
 481 gccgcgtggg cgacgacgtg ctggttcacc tgctggcacg ctgcgcgctc tttgtgctgg
 541 tggctcccag ctgcgcctac caggtgtgcg ggccgccgct gtaccagctc ggcgctgcca
 601 ctcaggcccg gccccgcca cacgctagtg accccgaag gcgtctggga tgcgaacggg
 661 cctggaacca tagcgtcagg gaggccgggg tccccctggg cctgccagcc ccgggtgcga
 721 ggaggcgcgg gggcagtgcc agccgaagtc tgccgttgcc caagaggccc aggcgtggcg
 781 ctgcccctga gccggagcgg acgcccgttg ggcagggtc ctgggcccac ccgggcagga
 841 cgcgtggacc gagtgaccgt ggtttctgtg tggtgtcacc tgccagaccc gccgaagaag
 901 ccacctcttt ggagggtgcg ctctctggca cgcgccactc ccacccatcc gtgggccgcc
 961 agcaccacgc gggccccca tccacatcgc ggccaccacg tccctgggac acgccttgtc
1021 ccccggtgta cgccgagacc aagcacttcc tctactcctc aggcgacaag gagcagctgc
1081 ggccctcctt cctactcagc tctctgaggc ccagcctgac tggcgctcgg aggctcgtgg
1141 agaccatctt tctgggttcc aggccctgga tgccagggac tccccgcagg ttgccccgcc
1201 tgccccagcg ctactggcaa atgcggcccc tgtttctgga gctgcttggg aaccacgcgc
1261 agtgccccta cggggtgctc ctcaagacgc actgcccgct gcgagctgcg gtcacccag
1321 cagccggtgt ctgtgcccgg gagaagcccc agggctctgt ggcggccccc gaggaggagg
1381 acacagaccc ccgtcgcctg gtgcagctgc tccgccagca cagcagcccc tggcaggtgt
1441 acggcttcgt gcgggcctgc ctgcgccggc tggtgccccc aggcctctgg ggctccaggc
1501 acaacgaacg ccgcttcctc aggaacacca agaagttcat ctccctgggg aagcatgcca
1561 agctctcgct gcaggagctg acgtggaaga tgagcgtgcg gggctgcgct tggctgcgca
1621 ggagcccagg ggttggctgt gttccggccg cagagcaccg tctgcgtgag gagatcctgg
1681 ccaagttcct gcactggctg atgagtgtgt acgtcgtcga gctgctcagg tctttctttt
1741 atgtcacgga gaccacgttt caaaagaaca ggctcttttt ctaccggaag agtgtctgga
1801 gcaagttgca aagcattgga atcagacagc acttgaagag ggtgcagctg cgggagctgt
1861 cggaagcaga ggtcaggcag catcgggaag ccaggcccgc cctgctgacg tccagactcc
1921 gcttcatccc caagcctgac gggctgcggc cgattgtgaa catggactac gtcgtgggag
1981 ccagaacgtt ccgcagagaa aagagggccg agcgtctcac ctcgagggtg aaggcactgt
2041 tcagcgtgct caactacgag cgggcgcggc gccccggcct cctgggcgcc tctgtgctgg
2101 gcctggacga tatccacagg gcctggcgca ccttcgtgct gcgtgtgcgg gcccaggacc
2161 cgccgcctga gctgtacttt gtcaaggtg atgtgacggg cgcgtacgac accatccccc
2221 aggacaggct cacggaggtc atcgccagca tcatcaaacc ccagaacacg tactgcgtgc
```

```
-continued
2281 gtcggtatgc cgtggtccag aaggccgccc atgggcacgt ccgcaaggcc ttcaagagcc 2341 acgtctctac cttgacagac ctccagccgt acatgcgaca gttcgtggct cacctgcagg 2401 agaccagccc gctgagggat gccgtcgtca tcgagcagag ctcctccctg aatgaggcca 2461 gcagtggcct cttcgacgtc ttcctacgct tcatgtgcca ccacgccgtg cgcatcaggg 2521 gcaagtccta cgtccagtgc caggggatcc cgcagggctc catcctctcc acgctgctct 2581 gcagcctgtg ctacgcgac atggagaaca agctgtttgc ggggattcgg cgggacgggc 2641 tgctcctgcg tttggtggat gatttcttgt tggtgacacc tcacctcacc cacgcgaaaa 2701 ccttcctcag gaccctggtc cgaggtgtcc ctgagtatgg ctgcgtggtg aacttgcgga 2761 agacagtggt gaacttccct gtagaagacg aggccctggg tggcacggct tttgttcaga 2821 tgccggccca cggcctattc ccctggtgcg gcctgctgct ggatacccgg accctggagg 2881 tgcagagcga ctactccagc tatgcccgga cctccatcag agccagtctc accttcaacc 2941 gcggcttcaa ggctgggagg aacatgcgtc gcaaactctt tggggtcttg cggctgaagt 3001 gtcacagcct gtttctggat ttgcaggtga acagcctcca gacggtgtgc accaacatct 3061 acaagatcct cctgctgcag gcgtacaggt ttcacgcatg tgtgctgcag ctcccatttc 3121 atcagcaagt ttggaagaac cccacatttt tcctgcgcgt catctctgac acggcctccc 3181 tctgctactc catcctgaaa gccaagaacg cagggatgtc gctgggggcc aagggcgccg 3241 ccggccctct gccctccgag gccgtgcagt ggctgtgcca ccaagcattc ctgctcaagc 3301 tgactcgaca ccgtgtcacc tacgtgccac tcctggggtc actcaggaca gcccagacgc 3361 agctgagtcg gaagctcccg gggacgacgc tgactgccct ggaggccgca gccaacccgg 3421 cactgccctc agacttcaag accatcctgg actgatggcc acccgcccac agccaggccg 3481 agagcagaca ccagcagccc tgtcacgccg ggctctacgt cccagggagg gaggggcggc 3541 ccacacccag gcccgcaccg ctgggagtct gaggcctgag tgagtgtttg gccgaggcct 3601 gcatgtccgg ctgaaggctg agtgtccggc tgaggcctga gcgagtgtcc agccaagggc 3661 tgagtgtcca gcacacctgc cgtcttcact tccccacagg ctggcgctcg gctccacccc 3721 agggccagct tttcctcacc aggagcccgg cttccactcc ccacatagga atagtccatc 3781 cccagattcg ccattgttca cccctcgccc tgccctcctt tgccttccac ccccaccatc 3841 caggtggaga ccctgagaag gaccctggga gctctgggaa tttggagtga ccaaggtgt 3901 gccctgtaca caggcgagga ccctgcacct ggatgggggt ccctgtgggt caaattgggg 3961 ggaggtgctg tgggagtaaa atactgaata tatgagtttt tcagttttga aaaaaaaaa 4021 aaaaaaa
```

In an embodiment, the hTERT is encoded by a nucleic acid having a sequence at least 80%, 85%, 90%, 95%, 96, 97%, 98%, or 99% identical to the sequence of SEQ ID NO: 607. In an embodiment, the hTERT is encoded by a nucleic acid of SEQ ID NO: 607.

Activation and Expansion of Cells

Cells may be activated and expanded generally using methods as described, for example, in U.S. Pat. Nos. 6,352, 694; 6,534,055; 6,905,680; 6,692,964; 5,858,358; 6,887, 466; 6,905,681; 7,144,575; 7,067,318; 7,172,869; 7,232, 566; 7,175,843; 5,883,223; 6,905,874; 6,797,514; 6,867, 041; and U.S. Patent Application Publication No. 20060121005.

Generally, the T cells of the invention may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values therebetween. In one aspect of the present invention, more anti-CD28 antibody is bound to the particles than anti-CD3 antibody, i.e., the ratio of CD3:CD28 is less than one. In certain aspects of the invention, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects of the present invention, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion.

Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a CD123 CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD123 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD123 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD123 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one aspect of the present invention, the mixture may be cultured for several hours (about 3 hours) to about 14 days or any hourly integer value in between. In one aspect, the mixture may be cultured for 21 days. In one aspect of the invention the beads and the T cells are cultured together for about eight days. In one aspect, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., CAR-expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CD123 CAR is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CD123 CAR are described in further detail below.

Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of CD4$^+$ and CD8$^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of CAR$^+$ T cells following antigen stimulation can be measured by flow cytometry. For example, a mixture of CD4$^+$ and CD8$^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the CD4$^+$ and/or CD8$^+$ T cell subsets by flow cytometry. See, e.g., Milone et al., Molecular Therapy 17(8): 1453-1464 (2009). Alternatively, a mixture of CD4$^+$ and CD8$^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either CD19$^+$ K562 cells (K562-CD19), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. GFP$^+$ T cells are enumerated by flow cytometry using bead-based counting. See, e.g., Milone et al., Molecular Therapy 17(8): 1453-1464 (2009). Similar assays can be performed using anti-CD123 T cells (see, e.g. Gill et al Blood 2014; 123:2343) or with anti-CD123 CAR T cells.

Sustained CAR$^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human CD19-specific CAR$^+$ T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of αCD19-ζ and αCD19-BB-ζ engineered T cells are coinjected at a 1:1 ratio into NOD-SCID-γ$^{-/-}$ mice bearing B-ALL. The number of copies of αCD19-ζ and αCD19-BB-ζ vector in spleen DNA from mice is evaluated at various times following T cell injection. Animals are assessed for leukemia at weekly intervals. Peripheral blood CD19$^+$ B-ALL blast cell counts are measured in mice that are injected with αCD19-ζ CAR$^+$ T cells or mock-transduced T cells. Survival curves for the groups are compared using the log-rank test. In addition, absolute peripheral blood CD4$^+$ and CD8$^+$ T cell counts 4 weeks following T cell injection in NOD-SCID-γ$^{-/-}$ mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input GFP$^+$ T cells by mixing with mock-transduced cells prior to injection, and confirmed by flow cytometry. Animals are assessed for leukemia at 1-week intervals. Survival curves for the CAR$^+$ T cell groups are compared using the log-rank test. Similar experiments can be done with CD123 CARTS.

Dose dependent CAR treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood CD19$^+$ ALL blast counts and then killed on days 35 and 49. The remaining animals are evaluated on days 57 and 70. Similar experiments can be done with CD123 CARTS.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing CD19 (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8$^+$ T cell expansion ex vivo. T cells are enumerated in cultures using CountBright™ fluorescent beads (Invitrogen, Carlsbad, Calif.) and flow cytometry as described by the manufacturer. CAR$^+$ T cells are identified by GFP expression using T cells that are engineered with eGFP-2A linked CAR-expressing lentiviral vectors. For CAR+ T cells not expressing GFP, the CAR+ T cells are detected with biotinylated recombinant CD123 protein and a secondary avidin-PE conjugate. CD4+ and CD8$^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, Calif.) according the manufacturer's instructions or using a Luminex 30-plex kit (Invitrogen). Fluorescence is assessed using a BD Fortessa flow cytometer, and data is analyzed according to the manufacturer's instructions. Similar experiments can be done with CD123 CARTS.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/$\gamma c^{-/-}$ (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR$^+$ T cells in Nalm-6 xenograft model can be measured as the following: NSG mice are injected with Nalm-6 transduced to stably express firefly luciferase, followed by a single tail-vein injection of T cells electroporated with CD123 CAR 7 days later. Animals are imaged at various time points post injection. For example, photon-density heat maps of firefly luciferasepositive leukemia in representative mice at day 5 (2 days before treatment) and day 8 (24 hr post CAR$^+$PBLs) can be generated.

Other assays, including those described in the Example section herein as well as those that are known in the art can also be used to evaluate the CD123 CAR constructs of the invention.

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present.

Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In one embodiment, the anti-idiotypic antibody molecule recognizes an anti-CD19 antibody molecule, e.g., an anti-CD19 scFv. For instance, the anti-idiotypic antibody molecule can compete for binding with the CD19-specific CAR mAb clone no. 136.20.1 described in Jena et al., PLOS March 2013 8:3 e57838; may have the same CDRs (e.g., one or more of, e.g., all of, VH CDR1, VH CDR2, CH CDR3, VL CDR1, VL CDR2, and VL CDR3, using the Kabat definition, the Chothia definition, or a combination of the Kabat and Chothia definitions) as the CD19-specific CAR mAb clone no. 136.20.1; may have one or more (e.g., 2) variable regions as the CD19-specific CAR mAb clone no. 136.20.1, or may comprise the CD19-specific CAR mAb clone no. 136.20.1. In some embodiments, the anti-idiotypic antibody was made according to a method described in Jena et al. In another embodiment, the anti-idiotypic antibody molecule is an anti-idiotypic antibody molecule described in WO 2014/190273. In some embodiments, the anti-idiotypic antibody molecule has the same CDRs (e.g., one or more of, e.g., all of, VH CDR1, VH CDR2, CH CDR3, VL CDR1, VL CDR2, and VL CDR3) as an antibody molecule of WO 2014/190273 such as 136.20.1; may have one or more (e.g., 2) variable regions of an antibody molecule of WO 2014/190273, or may comprise an antibody molecule of WO 2014/190273 such as 136.20.1. In other embodiments, the anti-CAR antibody binds to a constant region of the extracellular binding domain of the CAR molecule, e.g., as described in WO 2014/190273. In some embodiments, the anti-CAR antibody binds to a constant region of the extracellular binding domain of the CAR molecule, e.g., a heavy chain constant region (e.g., a CH2-CH3 hinge region) or light chain constant region. For instance, in some embodiments the anti-CAR antibody competes for binding with the 2D3 monoclonal antibody described in WO 2014/190273, has the same CDRs (e.g., one or more of, e.g., all of, VH CDR1, VH CDR2, CH CDR3, VL CDR1, VL CDR2, and VL CDR3) as 2D3, or has one or more (e.g., 2) variable regions of 2D3, or comprises 2D3 as described in WO 2014/190273.

In some aspects and embodiments, the compositions and methods herein are optimized for a specific subset of T cells, e.g., as described in U.S. Ser. No. 62/031,699 filed Jul. 31, 2014, the contents of which are incorporated herein by reference in their entirety. In some embodiments, the optimized subsets of T cells display an enhanced persistence compared to a control T cell, e.g., a T cell of a different type (e.g., $CD8^+$ or $CD4^+$) expressing the same construct.

In some embodiments, a $CD4^+$ T cell comprises a CAR described herein, which CAR comprises an intracellular signaling domain suitable for (e.g., optimized for, e.g., leading to enhanced persistence in) a $CD4^+$ T cell, e.g., an ICOS domain. In some embodiments, a $CD8^+$ T cell comprises a CAR described herein, which CAR comprises an intracellular signaling domain suitable for (e.g., optimized for, e.g., leading to enhanced persistence of) a $CD8^+$ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain that specifically binds CD123, e.g., a CAR of Table 2 or Table 6.

In an aspect, described herein is a method of treating a subject, e.g., a subject having cancer. The method includes administering to said subject, an effective amount of:

1) a $CD4^+$ T cell comprising a CAR (the $CAR^{CD4+}$) comprising:
an antigen binding domain, e.g., an antigen binding domain described herein, e.g., an antigen binding domain that specifically binds CD123, e.g., an antigen-binding domain of Table 2, Table 6, or Table 9;
a transmembrane domain; and
an intracellular signaling domain, e.g., a first costimulatory domain, e.g., an ICOS domain; and
2) a $CD8^+$ T cell comprising a CAR (the $CAR^{CD8+}$) comprising:
an antigen binding domain, e.g., an antigen binding domain described herein, e.g., an antigen binding domain that specifically binds CD123, e.g., an antigen-binding domain of Table 2, Table 6, or Table 9;
a transmembrane domain; and
an intracellular signaling domain, e.g., a second co stimulatory domain, e.g., a 4-1BB domain, a CD28 domain, or another costimulatory domain other than an ICOS domain;
wherein the $CAR^{CD4+}$ and the $CAR^{CD8+}$ differ from one another.

Optionally, the method further includes administering:
3) a second CD8+ T cell comprising a CAR (the second $CAR^{CD8+}$) comprising:
an antigen binding domain, e.g., an antigen binding domain described herein, e.g., an antigen binding domain that specifically binds CD123, e.g., an antigen-binding domain of Table 2, Table 6, or Table 9;
a transmembrane domain; and
an intracellular signaling domain, wherein the second $CAR^{CD8+}$ comprises an intracellular signaling domain, e.g., a costimulatory signaling domain, not present on the $CAR^{CD8+}$, and, optionally, does not comprise an ICOS signaling domain.

Therapeutic Application
CD123 Associated Diseases and/or Disorders

The present invention provides, among other things, compositions and methods for treating a disease associated with expression of CD123 or condition associated with cells which express CD123 including, e.g., a proliferative disease such as a cancer or malignancy or a precancerous condition such as a myelodysplasia, a myelodysplastic syndrome or a preleukemia; or a noncancer related indication associated with cells which express CD123. In one aspect, a cancer associated with expression of CD123 is a hematological cancer. In one aspect, a hematological cancer includes but is not limited to AML, myelodysplastic syndrome, ALL, chronic myeloid leukemia, blastic plasmacytoid dendritic cell neoplasm, myeloproliferative neoplasms, Hodgkin lymphoma, and the like. Further disease associated with expression of CD123 expression include, but are not limited to, e.g., atypical and/or non-classical cancers, malignancies, precancerous conditions or proliferative diseases associated with expression of CD123. Non-cancer related indications associated with expression of CD123 may also be included.

In one aspect, the invention provides methods for treating a disease associated with CD123 expression. In one aspect, the invention provides methods for treating a disease wherein part of the tumor is negative for CD123 and part of the tumor is positive for CD123. For example, the CAR of the invention is useful for treating subjects that have undergone treatment for a disease associated with elevated expression of CD123, wherein the subject that has undergone treatment for elevated levels of CD123 exhibits a disease associated with elevated levels of CD123. In embodiments, the CAR of the invention is useful for treating subjects that have undergone treatment for a disease associated with expression of CD123, wherein the subject that has undergone treatment related to expression of CD123 exhibits a disease associated with expression of CD123.

In one aspect, the invention pertains to a vector comprising CD123 CAR operably linked to promoter for expression in mammalian immune effector cells, e.g., T cells or NK cells. In one aspect, the invention provides a recombinant T cell expressing the CD123 CAR for use in treating CD123-expressing tumors, wherein the recombinant immune effector cells, e.g., T cells or NK cells expressing the CD123 CAR is termed a CD123 CAR-expressing cell (e.g., CD123 CART or CD123 CAR-expressing NK cell). In one aspect, the CD123 CART of the invention is capable of contacting a tumor cell with at least one CD123 CAR of the invention expressed on its surface such that the CD123 CAR-expressing cell (e.g., CD123 CART or CD123 CAR-expressing NK cell) targets the tumor cell and growth of the tumor is inhibited.

In one aspect, the invention pertains to a method of inhibiting growth of a CD123-expressing tumor cell, comprising contacting the tumor cell with a CD123 CAR-expressing cell (e.g., CD123 CART or CD123 CAR-expressing NK cell) of the present invention such that the CD123 CAR-expressing cell (e.g., CD123 CART or CD123 CAR-expressing NK cell) is activated in response to the antigen and targets the cancer cell, wherein the growth of the tumor is inhibited.

In one aspect, the invention pertains to a method of treating cancer in a subject. The method comprises administering to the subject a CD123 CAR-expressing cell (e.g., CD123 CART or CD123 CAR-expressing NK cell) of the present invention such that the cancer is treated in the subject. An example of a cancer that is treatable by the CD123 CAR-expressing cell (e.g., CD123 CART or CD123 CAR-expressing NK cell) of the invention is a cancer associated with expression of CD123. An example of a cancer that is treatable by the CD123 CAR-expressing cell (e.g., CD123 CART or CD123 CAR-expressing NK cell) of the invention includes but is not limited to AML, Hodgkin lymphoma, myelodysplastic syndrome, chronic myeloid leukemia and other myeloproliferative neoplasms, or Blastic plasmacytoid dendritic cell neoplasm, and the like.

The invention includes a type of cellular therapy where immune effector cells, e.g., T cells or NK cells, are genetically modified to express a chimeric antigen receptor (CAR) and the CD123 CAR-expressing cell (e.g., CD123 CART or CD123 CAR-expressing NK cell) is infused to a recipient in need thereof. The infused cell is able to kill tumor cells in the recipient. Unlike antibody therapies, CAR-modified immune effector cells, e.g., the CAR-modified T cells or CAR-modified NK cells) are able to replicate in vivo resulting in long-term persistence that can lead to sustained tumor control. In various aspects, the immune effector cells, e.g., T cells or NK cells, administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the immune effector cell, e.g., T cell or NK cell, to the patient.

The invention also includes a type of cellular therapy where immune effector cells, e.g., T cells or NK cells, are modified, e.g., by in vitro transcribed RNA, to transiently express a chimeric antigen receptor (CAR) and the CAR-expressing cell, e.g., CAR T cell or CAR NK cell) is infused to a recipient in need thereof. The infused cell is able to kill tumor cells in the recipient. Thus, in various aspects, the immune effector cells, e.g., T cells or NK cells, administered to the patient, is present for less than one month, e.g., three weeks, two weeks, one week, after administration of the immune effector cell, e.g., T cell or NK cell, to the patient.

Without wishing to be bound by any particular theory, the anti-tumor immunity response elicited by the CAR-modified immune effector cells, e.g., T cells or NK cells, may be an active or a passive immune response, or alternatively may be due to a direct vs indirect immune response. In one aspect, the CAR transduced immune effector cells, e.g., T cells or NK cells, exhibit specific proinflammatory cytokine secretion and potent cytolytic activity in response to human cancer cells expressing CD123, resist soluble CD123 inhibition, mediate bystander killing and mediate regression of an established human tumor. For example, antigen-less tumor cells within a heterogeneous field of CD123-expressing tumor may be susceptible to indirect destruction by CD123-redirected immune effector cell, e.g., T cells or NK cells, that has previously reacted against adjacent antigen-positive cancer cells.

In one aspect, the fully-human CAR-modified immune effector cells (e.g., T cells or NK cells) of the invention may be a type of vaccine for ex vivo immunization and/or in vivo therapy in a mammal. In one aspect, the mammal is a human.

With respect to ex vivo immunization, at least one of the following occurs in vitro prior to administering the cell, e.g., T cell or NK cell, into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified immune effector cells (e.g., T cells or NK cells) of the invention are used in the treatment of diseases, disorders and conditions associated with expression of CD123. In certain aspects, the cells of the invention are used in the treatment of patients at risk for developing diseases, disorders and conditions associated with expression of CD123. Thus, the present invention provides methods for the treatment or prevention of diseases, disorders and conditions associated with expression of CD123 comprising administering to a subject in need thereof, a therapeutically effective amount of the CAR-modified immune effector cells (e.g., T cells or NK cells) of the invention.

In one aspect, the CAR-expressing cells (CART cells or CAR-expressing NK cells) of the inventions may be used to treat a proliferative disease such as a cancer or malignancy or is a precancerous condition such as a myelodysplasia, a myelodysplastic syndrome or a preleukemia. In one aspect, a cancer associated with expression of CD123 is a hematological cancer preleukemia, a hyperproliferative disorder, a hyperplasia or a dysplasia, which is characterized by abnormal growth of cells.

In one aspect, the CAR-expressing cells (CART cells or CAR-expressing NK cells) of the invention are used to treat a cancer, wherein the cancer is a hematological cancer. Hematological cancer conditions are the types of cancer such as leukemia and malignant lymphoproliferative conditions that affect blood, bone marrow and the lymphatic system.

In one aspect, the compositions and CAR-expressing cells (CART cells or CAR-expressing NK cells) of the present invention are particularly useful for treating myeloid leukemias, AML and its subtypes, chronic myeloid leukemia (CML), myelodysplastic syndrome (MDS), myeloproliferative neoplasms (MPN), histiocytic disorders, and mast cell disorders.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

In AML, malignant transformation and uncontrolled proliferation of an abnormally differentiated, long-lived myeloid progenitor cell results in high circulating numbers of immature blood forms and replacement of normal marrow by malignant cells. Symptoms include fatigue, pallor, easy bruising and bleeding, fever, and infection; symptoms of leukemic infiltration are present in only about 5% of patients (often as skin manifestations). Examination of peripheral blood smear and bone marrow is diagnostic. Existing treatment includes induction chemotherapy to achieve remission and post-remission chemotherapy (with or without stem cell transplantation) to avoid relapse.

AML has a number of subtypes that are distinguished from each other by morphology, immunophenotype, and cytochemistry. Five classes are described, based on predominant cell type, including myeloid, myeloid-monocytic, monocytic, erythroid, and megakaryocytic.

Remission induction rates range from 50 to 85%. Long-term disease-free survival reportedly occurs in 20 to 40% of patients and increases to 40 to 50% in younger patients treated with stem cell transplantation.

Prognostic factors help determine treatment protocol and intensity; patients with strongly negative prognostic features are usually given more intense forms of therapy, because the potential benefits are thought to justify the increased treatment toxicity. The most important prognostic factor is the leukemia cell karyotype; favorable karyotypes include t(15; 17), t(8;21), and inv16 (p13;q22). Negative factors include increasing age, a preceding myelodysplastic phase, secondary leukemia, high WBC count, and absence of Auer rods.

Initial therapy attempts to induce remission and differs most from ALL in that AML responds to fewer drugs. The basic induction regimen includes cytarabine by continuous IV infusion or high doses for 5 to 7 days; daunorubicin or idarubicin is given IV for 3 days during this time. Some regimens include 6-thioguanine, etoposide, vincristine, and prednisone, but their contribution is unclear. Treatment usually results in significant myelosuppression, with infection or bleeding; there is significant latency before marrow recovery. During this time, meticulous preventive and supportive care is vital.

Chronic myelogenous (or myeloid) leukemia (CML) is also known as chronic granulocytic leukemia, and is characterized as a cancer of the white blood cells. Common treatment regimens for CML include Bcr-Abl tyrosine kinase inhibitors, imatinib (Gleevec®), dasatinib and nilotinib. Bcr-Abl tyrosine kinase inhibitors are specifically useful for CML patients with the Philadelphia chromosome translocation.

Myelodysplastic syndromes (MDS) are hematological medical conditions characterized by disorderly and ineffective hematopoiesis, or blood production. Thus, the number and quality of blood-forming cells decline irreversibly. Some patients with MDS can develop severe anemia, while others are asymptomatic. The classification scheme for MDS is known in the art, with criteria designating the ratio or frequency of particular blood cell types, e.g., myeloblasts, monocytes, and red cell precursors. MDS includes refractory anemia, refractory anemia with ring sideroblasts, refractory anemia with excess blasts, refractory anemia with excess blasts in transformation, chronic myelomonocytic leukemia (CML).

Treatments for MDS vary with the severity of the symptoms. Aggressive forms of treatment for patients experiencing severe symptoms include bone marrow transplants and supportive care with blood product support (e.g., blood transfusions) and hematopoietic growth factors (e.g., erythropoietin). Other agents are frequently used to treat MDS: 5-azacytidine, decitabine, and lenalidomide. In some cases, iron chelators deferoxamine (Desferal®) and deferasirox (Exjade®) may also be administered.

In another embodiment, the CAR-expressing cells (e.g., CART cells or CAR-expressing NK cells) of the present invention are used to treat cancers or leukemias with leukemia stem cells. For example, the leukemia stem cells are $CD34^+/CD38^-$ leukemia cells.

The present invention provides, among other things, compositions and methods for treating cancer. In one aspect, the cancer is a hematologic cancer including but is not limited to leukemia (such as acute myelogenous leukemia, chronic myelogenous leukemia, acute lymphoid leukemia, chronic lymphoid leukemia and myelodysplastic syndrome) and malignant lymphoproliferative conditions, including lymphoma (such as multiple myeloma, Hodgkin's lymphoma, non-Hodgkin's lymphoma, Burkitt's lymphoma, and small cell- and large cell-follicular lymphoma).

In one aspect, the CAR-expressing cells (e.g., CART cells or CAR-expressing NK cells) of the invention may be used to treat other cancers and malignancies such as, but not limited to, e.g., acute leukemias including but not limited to, e.g., B-cell acute lymphoid leukemia ("B-ALL"), T-cell acute lymphoid leukemia ("T-ALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, Hodgkin's lymphoma, non-Hodgkin's lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like The CAR-modified immune effector cells, e.g., T cells or NK cells, of the present invention may be administered either alone, or as a pharmaceutical composition in combination with diluents and/or with other components such as IL-2 or other cytokines or cell populations.

The present invention also provides methods for inhibiting the proliferation or reducing a CD123-expressing cell population, the methods comprising contacting a population of cells comprising a CD123-expressing cell with a CAR-expressing cell (e.g., CD123 CART cell or CD123 CAR-expressing NK cell) of the invention that binds to the CD123-expressing cell. In a specific aspect, the present invention provides methods for inhibiting the proliferation or reducing the population of cancer cells expressing CD123, the methods comprising contacting the CD123-expressing cancer cell population with a CAR-expressing cell (e.g., CD123 CART cell or CD123 CAR-expressing NK cell) of the invention that binds to the CD123-expressing cell. In one aspect, the present invention provides methods for inhibiting the proliferation or reducing the population of cancer cells expressing CD123, the methods comprising contacting the CD123-expressing cancer cell population with a CAR-expressing cell (e.g., CD123 CART cell or CD123 CAR-expressing NK cell) of the invention that binds to the CD123-expressing cell. In certain aspects, the CAR-expressing cell (e.g., CD123 CART cell or CD123 CAR-expressing NK cell) of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with CD123-expressing cells relative to a negative control. In one aspect, the subject is a human.

The present invention also provides methods for preventing, treating and/or managing a disease associated with CD123-expressing cells (e.g., a hematologic cancer or atypical cancer expressing CD123), the methods comprising administering to a subject in need a CAR-expressing cell (e.g., CD123 CART cell or CD123 CAR-expressing NK cell) of the invention that binds to the CD123-expressing cell. In one aspect, the subject is a human. Non-limiting examples of disorders associated with CD123-expressing cells include autoimmune disorders (such as lupus), inflammatory disorders (such as allergies and asthma) and cancers (such as hematological cancers or atypical cancers expressing CD123).

The present invention also provides methods for preventing, treating and/or managing a disease associated with CD123-expressing cells, the methods comprising administering to a subject in need a CAR-expressing cell (e.g., CD123 CART cell or CD123 CAR-expressing NK cell) of the invention that binds to the CD123-expressing cell. In one aspect, the subject is a human.

The present invention provides methods for preventing relapse of cancer associated with CD123-expressing cells, the methods comprising administering to a subject in need thereof a CAR-expressing cell (e.g., CD123 CART cell or CD123 CAR-expressing NK cell) of the invention that binds to the CD123-expressing cell. In one aspect, the methods comprise administering to the subject in need thereof an effective amount of a CAR-expressing cell (e.g., CD123 CART cell or CD123 CAR-expressing NK cell) described herein that binds to the CD123-expressing cell in combination with an effective amount of another therapy.

Bone Marrow Ablation

In one aspect, the present invention provides compositions and methods for bone marrow ablation. For example, in one aspect, the invention provides compositions and methods for eradication of at least a portion of existing bone marrow in a subject. It is described herein that, in certain instances, the CART123 cells comprising a CD123 CAR of the present invention eradicates CD123 positive bone marrow myeloid progenitor cells.

In one aspect, the invention provides a method of bone marrow ablation comprising administering a CAR-expressing cell (e.g., CD123 CART cell or CD123 CAR-expressing NK cell) of the invention to a subject in need of bone marrow ablation. For example, the present method may be used to eradicate some or all of the existing bone marrow of a subject having a disease or disorder in which bone marrow transplantation or bone marrow reconditioning is a beneficial treatment strategy. In one aspect, the bone marrow ablation method of the invention, comprising the administration of a CAR-expressing cell (e.g., CD123 CART cell or CD123 CAR-expressing NK cell) described elsewhere herein, is performed in a subject prior to bone marrow transplantation. Thus, in one aspect, the method of the invention provides a cellular conditioning regimen prior to bone marrow or stem cell transplantation. In one aspect, bone marrow transplantation comprises transplantation of a stem cell. The bone marrow transplantation may comprise transplantation of autologous or allogeneic cells.

The present invention provides a method of treating a disease or disorder comprising administering a CAR-expressing cell (e.g., CD123 CART cell or CD123 CAR-expressing NK cell) of the invention to eradicate at least a portion of existing bone marrow. The method may be used as at least a portion of a treatment regimen for treating any disease or disorder where bone marrow transplantation is beneficial. That is, the present method may be used in any subject in need of a bone marrow transplant. In one aspect, bone marrow ablation comprising administration of a CAR-expressing cell (e.g., CD123 CART cell or CD123 CAR-expressing NK cell) is useful in the treatment of AML. In certain aspects, bone marrow ablation by way of the present method is useful in treating a hematological cancer, a solid tumor, a hematologic disease, a metabolic disorder, HIV, HTLV, a lysosomal storage disorder, and an immunodeficiency.

Compositions and methods disclosed herein may be used to eradicate at least a portion of existing bone marrow to treat hematological cancers including, but not limited to, leukemia, lymphoma, myeloma, ALL, AML, CLL, CML, Hodgkin's lymphoma, Non-Hodgkin's lymphoma, and multiple myeloma.

Compositions and methods disclosed herein may be used to treat hematologic diseases including, but not limited to myelodysplasia, anemia, paroxysmal nocturnal hemoglobinuria, aplastic anemia, acquired pure red cell anemia, Diamon-Blackfan anemia, Fanconi anemia, cytopenia, amegakaryotic thrombocytopenia, myeloproliferative disorders, polycythemia vera, essential thrombocytosis, myelofibrosis, hemoglobinopathies, sickle cell disease, 0 thalassemia major, among others.

Compositions and methods disclosed herein may be used to treat lysosomal storage disorders including, but not limited to lipidoses, sphigolipodeses, leukodystrophies, mucopolysaccharidoses, glycoproteinoses, infantile neuronal ceroid lipofuscinosis, Jansky-Bielschowsky disease, Niemann-Pick disease, Gaucher disease, adrenoleukodystrophy, metachromatic leukodystrophy, Krabbe disease, Hurler syndrome, Scheie syndrome, Hurler-Scheie syndrome, hunter syndrome, Sanfilippo syndrome, Morquio syndrome, Maroteaux-Lamy syndrome, Sly syndrome, mucolipidosis, fucolipidosis, aspartylglucosaminuria, alpha-mannosidoses, and Wolman disease.

Compositions and methods disclosed herein may be used to treat immunodeficiencies including, but not limited to, T-cell deficiencies, combined T-cell and B-cell deficiencies, phagocyte disorders, immune dysregulation diseases, innate immune deficiencies, ataxia telangiectasia, DiGeorge syndrome, severe combined immunodeficiency (SCID), Wiskott-Aldrich syndrome, Kostmann syndrome, Shwachman-Diamond syndrome, Griscelli syndrome, and NF-Kappa-B Essential Modulator (NEMO) deficiency.

In one aspect, the present invention provides a method of treating cancer comprising bone marrow conditioning, where at least a portion of bone marrow of the subject is eradicated by the CAR-expressing cell (e.g., CD123 CART cell or CD123 CAR-expressing NK cell) of the invention. For example, in certain instances, the bone marrow of the subject comprises a malignant precursor cell that can be targeted and eliminated by the activity of the CAR-expressing cell (e.g., CD123 CART cell or CD123 CAR-expressing NK cell). In one aspect, a bone marrow conditioning therapy comprises administering a bone marrow or stem cell transplant to the subject following the eradication of native bone marrow. In one aspect, the bone marrow reconditioning therapy is combined with one or more other anti-cancer therapies, including, but not limited to anti-tumor CAR therapies, chemotherapy, radiation, and the like.

In one aspect, eradication of the administered CAR-expressing cell (e.g., CD123 CART cell or CD123 CAR-expressing NK cell) may be required prior to infusion of bone marrow or stem cell transplant. Eradication of the CAR-expressing cell (e.g., CD123 CART cell or CD123 CAR-expressing NK cell) may be accomplished using any suitable strategy or treatment, including, but not limited to, use of a suicide gene, limited CAR persistence using RNA encoded CARs, or anti-T cell modalities including antibodies or chemotherapy.

Combination Therapies

A CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a CAR-expressing cell described herein may be used in a treatment regimen in combination with surgery, cytokines, radiation, or chemotherapy such as cytoxan, fludarabine, histone deacetylase inhibitors, demethylating agents, or peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)). a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Anti-cancer agents of particular interest for combinations with the compounds of the present invention include: anthracyclines; alkylating agents; antimetabolites; drugs that inhibit either the calcium dependent phosphatase calcineurin or the p70S6 kinase FK506) or inhibit the p70S6 kinase; mTOR inhibitors; immunomodulators; anthracyclines; vinca alkaloids; proteosome inhibitors; GITR agonists; protein tyrosine phosphatase inhibitors; a CDK4 kinase inhibitor; a BTK inhibitor; a MKN kinase inhibitor; a DGK kinase inhibitor; or an oncolytic virus.

Exemplary antimetabolites include, without limitation, pyrimidine analogs, purine analogs and adenosine deaminase inhibitors): methotrexate (Rheumatrex®, Trexall®), 5-fluorouracil (Adrucil®, Efudex®, Fluoroplex®), floxuridine (FUDF®), cytarabine (Cytosar-U®, Tarabine PFS), 6-mercaptopurine (Puri-Nethol®)), 6-thioguanine (Thioguanine Tabloid®), fludarabine phosphate (Fludara®), pentostatin (Nipent®), pemetrexed (Alimta®), raltitrexed (Tomudex®), cladribine (Leustatin®), clofarabine (Clofarex®, Clolar®), azacitidine (Vidaza®), decitabine and gemcitabine (Gemzar®). Preferred antimetabolites include, cytarabine, clofarabine and fludarabine.

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

In embodiments, a CAR-expressing cell described herein is administered to a subject in combination with fludarabine, cyclophosphamide, and/or rituximab. In embodiments, a CAR-expressing cell described herein is administered to a subject in combination with fludarabine, cyclophosphamide, and rituximab (FCR). In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the fludarabine is administered at a dosage of about 10-50 mg/m$^2$ (e.g., about 10-15, 15-20, 20-25, 25-30, 30-35, 35-40, 40-45, or 45-50 mg/m$^2$), e.g., intravenously. In embodiments, the cyclophosphamide is administered at a dosage of about 200-300 mg/m$^2$ (e.g., about 200-225, 225-250, 250-275, or 275-300 mg/m$^2$), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with bendamustine and rituximab. In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the bendamustine is administered at a dosage of about 70-110 mg/m2 (e.g., 70-80, 80-90, 90-100, or 100-110 mg/m2), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with rituximab, cyclophosphamide, doxorubicine, vincristine, and/or a corticosteroid (e.g., prednisone). In embodiments, a CAR-expressing cell described herein is administered to a subject in combination with rituximab, cyclophosphamide, doxorubicine, vincristine, and prednisone (R-CHOP). In embodiments, the subject has diffuse large B-cell lymphoma (DLBCL). In embodiments, the subject has nonbulky limited-stage DLBCL (e.g., comprises a tumor having a size/diameter of less than 7 cm). In embodiments, the subject is treated with radiation in combination with the R-CHOP. For example, the subject is administered R-CHOP (e.g., 1-6 cycles, e.g., 1, 2, 3, 4, 5, or 6 cycles of R-CHOP), followed by radiation. In some cases, the subject is administered R-CHOP (e.g., 1-6 cycles, e.g., 1, 2, 3, 4, 5, or 6 cycles of R-CHOP) following radiation.

In embodiments, a CAR-expressing cell described herein is administered to a subject in combination with etoposide, prednisone, vincristine, cyclophosphamide, doxorubicin, and/or rituximab. In embodiments, a CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose-adjusted EPOCH-R (DA-EPOCH-R). In embodiments, the subject has a B cell lymphoma, e.g., a Myc-rearranged aggressive B cell lymphoma.

In embodiments, a CAR-expressing cell described herein is administered to a subject in combination with rituximab and/or lenalidomide. Lenalidomide ((RS)-3-(4-Amino-1-oxo 1,3-dihydro-2H-isoindol-2-yl)piperidine-2,6-dione) is an immunomodulator. In embodiments, a CAR-expressing cell described herein is administered to a subject in combination with rituximab and lenalidomide. In embodiments, the subject has follicular lymphoma (FL) or mantle cell lymphoma (MCL). In embodiments, the subject has FL and has not previously been treated with a cancer therapy. In embodiments, lenalidomide is administered at a dosage of about 10-20 mg (e.g., 10-15 or 15-20 mg), e.g., daily. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 706), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N-((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In embodiments, a CAR-expressing cell described herein is administered to a subject in combination with brentuximab. Brentuximab is an antibody-drug conjugate of anti-CD30 antibody and monomethyl auristatin E. In embodiments, the subject has Hodgkin's lymphoma (HL), e.g., relapsed or refractory HL. In embodiments, the subject comprises CD30+ HL. In embodiments, the subject has undergone an autologous stem cell transplant (ASCT). In embodiments, the subject has not undergone an ASCT. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In embodiments, a CAR-expressing cell described herein is administered to a subject in combination with brentuximab and dacarbazine or in combination with brentuximab and bendamustine. Dacarbazine is an alkylating agent with a chemical name of 5-(3,3-Dimethyl-1-triazenyl)imidazole-4-carboxamide. Bendamustine is an alkylating agent with a chemical name of 4-[5-[Bis(2-chloroethyl)amino]-1-methylbenzimidazol-2-yl]butanoic acid. In embodiments, the subject has Hodgkin's lymphoma (HL). In embodiments, the subject has not previously been treated with a cancer therapy. In embodiments, the subject is at least 60 years of age, e.g., 60, 65, 70, 75, 80, 85, or older. In embodiments, dacarbazine is administered at a dosage of about 300-450 mg/m$^2$ (e.g., about 300-325, 325-350, 350-375, 375-400, 400-425, or 425-450 mg/m$^2$), e.g., intravenously. In embodiments, bendamustine is administered at a dosage of about 75-125 mg/m2 (e.g., 75-100 or 100-125 mg/m$^2$, e.g., about 90 mg/m$^2$), e.g., intravenously. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof. Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/

103705s5311lbl.pdf. In embodiments, a CAR-expressing cell described herein is administered to a subject in combination with rituximab. In embodiments, the subject has CLL or SLL.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab. In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject. In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more. In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NSO). See, e.g., www.accessdata.fda.gov/drugsatfda_docs/label/2009/125326lbl.pdf; and Clinical Trial Identifier number NCT01363128, NCT01515176, NCT01626352, and NCT01397591. In embodiments, a CAR-expressing cell described herein is administered to a subject in combination with ofatumumab. In embodiments, the subject has CLL or SLL.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab. In embodiments, ofatumumab is administered at a starting dosage of about 300 mg, followed by 2000 mg, e.g., for about 11 doses, e.g., for 24 weeks. In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some cases, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87.

In some cases, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some cases, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdatafda.gov/drugsatfda_docs/label/2013/125486s000lbl.pdf.

In some cases, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some cases, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; and Clinical Trial Identifier No. NCT00452127.

In some cases, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or anti-emetic), pain reliever, or cytoprotective agent described herein.

In embodiments, a CAR-expressing cell described herein is administered to a subject in combination with a B-cell lymphoma 2 (BCL-2) inhibitor (e.g., venetoclax, also called ABT-199 or GDC-0199) and/or rituximab. In embodiments, a CAR-expressing cell described herein is administered to a subject in combination with venetoclax and rituximab. Venetoclax is a small molecule that inhibits the anti-apoptotic protein, BCL-2. The structure of venetoclax (4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) is shown below.

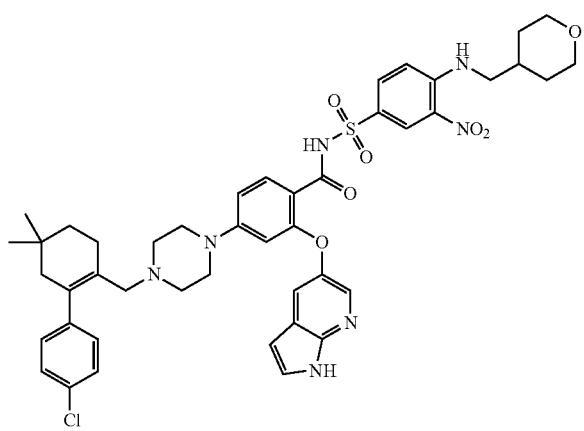 [SMILES: CC1(C)CCC(CN2CCN(c3ccc(C(=O)NS(=O)(=O)c4ccc(NCC5CCOCC5)c([N+](=O)[O-])c4)c(Oc4cnc5[nH]ccc5c4)c3)CC2)=C(c2ccc(Cl)cc2)C1]

In embodiments, the subject has CLL. In embodiments, the subject has relapsed CLL, e.g., the subject has previously been administered a cancer therapy. In embodiments, venetoclax is administered at a dosage of about 15-600 mg (e.g., 15-20, 20-50, 50-75, 75-100, 100-200, 200-300, 300-400, 400-500, or 500-600 mg), e.g., daily. In embodiments, rituximab is administered at a dosage of about 350-550 mg/m2 (e.g., 350-375, 375-400, 400-425, 425-450, 450-475, or 475-500 mg/m2), e.g., intravenously, e.g., monthly.

In some embodiments, a CAR-expressing cell described herein is administered in combination with an oncolytic virus. In embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

In some embodiments, the oncolytic virus is a virus, e.g., recombinant oncolytic virus, described in US2010/0178684 A1, which is incorporated herein by reference in its entirety. In some embodiments, a recombinant oncolytic virus comprises a nucleic acid sequence (e.g., heterologous nucleic acid sequence) encoding an inhibitor of an immune or inflammatory response, e.g., as described in US2010/0178684 A1, incorporated herein by reference in its entirety. In embodiments, the recombinant oncolytic virus, e.g., oncolytic NDV, comprises a pro-apoptotic protein (e.g., apoptin), a cytokine (e.g., GM-CSF, interferon-gamma, interleukin-2 (IL-2), tumor necrosis factor-alpha), an immunoglobulin (e.g., an antibody against ED-B firbonectin), tumor associated antigen, a bispecific adapter protein (e.g., bispecific antibody or antibody fragment directed against NDV HN protein and a T cell co-stimulatory receptor, such as CD3 or CD28; or fusion protein between human IL-2 and single chain antibody directed against NDV HN protein). See, e.g., Zamarin et al. Future Microbiol. 7.3(2012):347-67, incorporated herein by reference in its entirety. In some embodiments, the oncolytic virus is a chimeric oncolytic NDV described in U.S. Pat. No. 8,591,881 B2, US 2012/0122185 A1, or US 2014/0271677 A1, each of which is incorporated herein by reference in their entireties.

In some embodiments, the oncolytic virus comprises a conditionally replicative adenovirus (CRAd), which is designed to replicate exclusively in cancer cells. See, e.g., Alemany et al. Nature Biotechnol. 18(2000):723-27. In some embodiments, an oncolytic adenovirus comprises one described in Table 1 on page 725 of Alemany et al., incorporated herein by reference in its entirety.

Exemplary oncolytic viruses include but are not limited to the following:

Group B Oncolytic Adenovirus (ColoAd1) (PsiOxus Therapeutics Ltd.) (see, e.g., Clinical Trial Identifier: NCT02053220);

ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);

VCN-01, which is a genetically modified oncolytic human adenovirus encoding human PH20 hyaluronidase (VCN Biosciences, S.L.) (see, e.g., Clinical Trial Identifiers: NCT02045602 and NCT02045589);

Conditionally Replicative Adenovirus ICOVIR-5, which is a virus derived from wild-type human adenovirus serotype 5 (Had5) that has been modified to selectively replicate in cancer cells with a deregulated retinoblastoma/E2F pathway (Institut Catalá d'Oncologia) (see, e.g., Clinical Trial Identifier: NCT01864759);

Celyvir, which comprises bone marrow-derived autologous mesenchymal stem cells (MSCs) infected with ICOVIR5, an oncolytic adenovirus (Hospital Infantil Universitario Niño Jesús, Madrid, Spain/Ramon Alemany) (see, e.g., Clinical Trial Identifier: NCT01844661);

CG0070, which is a conditionally replicating oncolytic serotype 5 adenovirus (Ad5) in which human E2F-1 promoter drives expression of the essential E1a viral genes, thereby restricting viral replication and cytotoxicity to Rb pathway-defective tumor cells (Cold Genesys, Inc.) (see, e.g., Clinical Trial Identifier: NCT02143804); or DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intraarterial, intravenous, intramuscular, intrathecal, or intraperitoneal injection. In embodiments, an oncolytic virus described herein is administered intratumorally, transdermally, transmuco sally, orally, intranasally, or via pulmonary administration.

In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse.

In one embodiment, a CAR expressing cell described herein are administered to a subject in combination with a molecule targeting GITR and/or modulating GITR functions, such as a GITR agonist and/or a GITR antibody that depletes regulatory T cells (Tregs). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to apheresis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells.

In one embodiment, a CAR expressing cell described herein is administered to a subject in combination with an mTOR inhibitor, e.g., an mTOR inhibitor described herein, e.g., a rapalog such as everolimus. In one embodiment, the mTOR inhibitor is administered prior to the CAR-expressing cell. For example, in one embodiment, the mTOR inhibitor can be administered prior to apheresis of the cells.

In one embodiment, a CAR expressing cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment, a CAR-expressing cell described herein can be used in combination with a kinase inhibitor. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor. In one embodiment, the kinase inhibitor is a DGK inhibitor, e.g., a DGK inhibitor described herein, such as, e.g., DGKinh1 (D5919) or DGKinh2 (D5794). In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In embodiments, a CAR-expressing cell described herein is administered to a subject in combination with a cyclin-dependent kinase (CDK) 4 or 6 inhibitor, e.g., a CDK4 inhibitor or a CDK6 inhibitor described herein. In embodiments, a CAR-expressing cell described herein is administered to a subject in combination with a CDK4/6 inhibitor (e.g., an inhibitor that targets both CDK4 and CDK6), e.g., a CDK4/6 inhibitor described herein. In an embodiment, the subject has MCL. MCL is an aggressive cancer that is poorly responsive to currently available therapies, i.e., essentially incurable. In many cases of MCL, cyclin D1 (a regulator of CDK4/6) is expressed (e.g., due to chromosomal translocation involving immunoglobulin and Cyclin D1 genes) in MCL cells. Thus, without being bound by theory, it is thought that MCL cells are highly sensitive to CDK4/6 inhibition with high specificity (i.e., minimal effect on normal immune cells). CDK4/6 inhibitors alone have had some efficacy in treating MCL, but have only achieved partial remission with a high relapse rate. An exemplary CDK4/6 inhibitor is LEE011 (also called ribociclib), the structure of which is shown below.

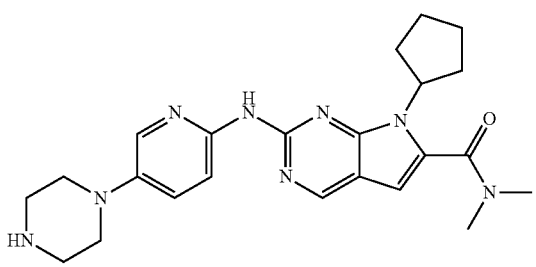 [SMILES: CN(C)C(=O)c1cc2cnc(Nc3ccc(N4CCNCC4)cn3)nc2n1C1CCCC1]

Without being bound by theory, it is believed that administration of a CAR-expressing cell described herein with a CDK4/6 inhibitor (e.g., LEE011 or other CDK4/6 inhibitor described herein) can achieve higher responsiveness, e.g., with higher remission rates and/or lower relapse rates, e.g., compared to a CDK4/6 inhibitor alone.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In a preferred embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In embodiments, a CAR-expressing cell described herein is administered to a subject in combination with a BTK inhibitor (e.g., ibrutinib). In embodiments, a CAR-expressing cell described herein is administered to a subject in combination with ibrutinib (also called PCI-32765). The structure of ibrutinib (1-[(3R)-3-[4-Amino-3-(4-phenoxyphenyl)-1H-pyrazolo[3,4-d]pyrimidin-1-yl]piperidin-1-yl]prop-2-en-1-one) is shown below.

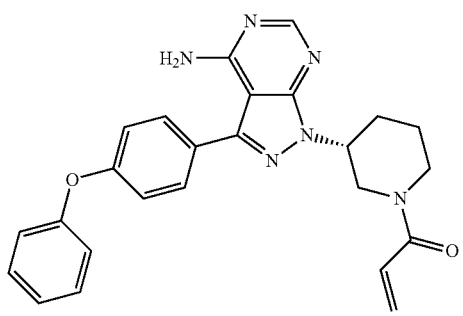 [SMILES: C=CC(=O)N1CCC[C@@H](n2nc(-c3ccc(Oc4ccccc4)cc3)c3c(N)ncnc32)C1]

In embodiments, the subject has CLL, mantle cell lymphoma (MCL), or small lymphocytic lymphoma (SLL). For example, the subject has a deletion in the short arm of chromosome 17 (del(17p), e.g., in a leukemic cell). In other examples, the subject does not have a del(17p). In embodiments, the subject has relapsed CLL or SLL, e.g., the subject has previously been administered a cancer therapy (e.g., previously been administered one, two, three, or four prior cancer therapies). In embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al. (2013) Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at $55^{th}$ ASH Annual Meeting and Exposition, New Orleans, La. 7-10 December. Without being bound by theory, it is thought that the addition of ibrutinib enhances the T cell proliferative response and may shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In some embodiments of the methods, uses, and compositions herein, the BTK inhibitor is a BTK inhibitor described in International Application WO/2015/079417, which is herein incorporated by reference in its entirety. For instance, in some embodiments, the BTK inhibitor is a compound of formula (I) or a pharmaceutically acceptable salt thereof;

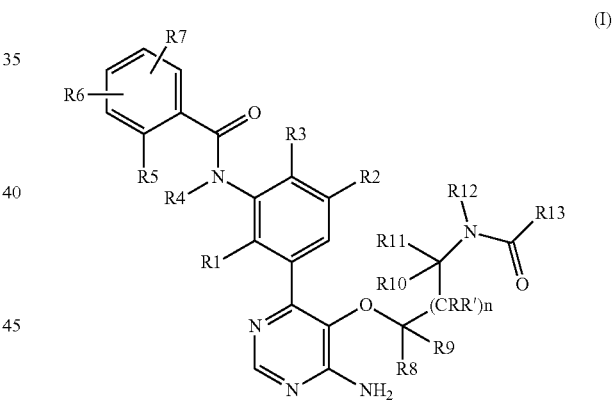

wherein,

R1 is hydrogen, C1-C6 alkyl optionally substituted by hydroxy;

R2 is hydrogen or halogen;

R3 is hydrogen or halogen;

R4 is hydrogen;

R5 is hydrogen or halogen;

or R4 and R5 are attached to each other and stand for a bond, —CH2-, —CH2-CH2-, —CH═CH—, —CH═CH—CH2-; —CH2-CH═CH—; or —CH2-CH2-CH2-;

R6 and R7 stand independently from each other for H, C1-C6 alkyl optionally substituted by hydroxyl, C3-C6 cycloalkyl optionally substituted by halogen or hydroxy, or halogen;

R8, R9, R, R', R10 and R11 independently from each other stand for H, or C1-C6 alkyl optionally substituted by C1-C6 alkoxy; or any two of R8, R9, R, R', R10 and R11 together with the carbon atom to which they are bound may form a 3-6 membered saturated carbocyclic ring;

R12 is hydrogen or C1-C6 alkyl optionally substituted by halogen or C1-C6 alkoxy;

or R12 and any one of R8, R9, R, R', R10 or R11 together with the atoms to which they are bound may form a 4, 5, 6 or 7 membered azacyclic ring, which ring may optionally be substituted by halogen, cyano, hydroxyl, C1-C6 alkyl or C1-C6 alkoxy;

n is 0 or 1; and

R13 is C2-C6 alkenyl optionally substituted by C1-C6 alkyl, C1-C6 alkoxy or N,N-di-C1-C6 alkyl amino; C2-C6 alkynyl optionally substituted by C1-C6 alkyl or C1-C6 alkoxy; or C2-C6 alkylenyl oxide optionally substituted by C1-C6 alkyl.

In some embodiments, the BTK inhibitor of Formula I is chosen from: N-(3-(5-((1-Acryloylazetidin-3-yl)oxy)-6-aminopyrimidin-4-yl)-5-fluoro-2-methylphenyl)-4-cyclopropyl-2-fluorobenzamide; (E)-N-(3-(6-Amino-5-((1-(but-2-enoyl)azetidin-3-yl)oxy)pyrimidin-4-yl)-5-fluoro-2-methylphenyl)-4-cyclopropyl-2-fluorobenzamide; N-(3-(6-Amino-5-((1-propioloylazetidin-3-yl)oxy)pyrimidin-4-yl)-5-fluoro-2-methylphenyl)-4-cyclopropyl-2-fluorobenzamide; N-(3-(6-Amino-5-((1-(but-2-ynoyl)azetidin-3-yl)oxy)pyrimidin-4-yl)-5-fluoro-2-methylphenyl)-4-cyclopropyl-2-fluorobenzamide; N-(3-(5-((1-Acryloylpiperidin-4-yl)oxy)-6-aminopyrimidin-4-yl)-5-fluoro-2-methylphenyl)-4-cyclopropyl-2-fluorobenzamide; N-(3-(6-Amino-5-(2-(N-methylacrylamido)ethoxy)pyrimidin-4-yl)-5-fluoro-2-methylphenyl)-4-cyclopropyl-2-fluorobenzamide; (E)-N-(3-(6-Amino-5-(2-(N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylpropiolamido)ethoxy)pyrimidin-4-yl)-5-fluoro-2-methylphenyl)-4-cyclopropyl-2-fluorobenzamide; (E)-N-(3-(6-Amino-5-(2-(4-methoxy-N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylbut-2-ynamido)ethoxy)pyrimidin-4-yl)-5-fluoro-2-methylphenyl)-4-cyclopropyl-2-fluorobenzamide; N-(2-((4-Amino-6-(3-(4-cyclopropyl-2-fluorobenzamido)-5-fluoro-2-methylphenyl)pyrimidin-5-yl)oxy)ethyl)-N-methyloxirane-2-carboxamide; N-(2-((4-Amino-6-(3-(6-cyclopropyl-8-fluoro-1-oxoisoquinolin-2(1H)-yl)phenyl)pyrimidin-5-yl)oxy)ethyl)-N-methylacrylamide; N-(3-(5-(2-Acrylamidoethoxy)-6-aminopyrimidin-4-yl)-5-fluoro-2-methylphenyl)-4-cyclopropyl-2-fluorobenzamide; N-(3-(6-Amino-5-(2-(N-ethylacrylamido)ethoxy)pyrimidin-4-yl)-5-fluoro-2-methylphenyl)-4-cyclopropyl-2-fluorobenzamide; N-(3-(6-Amino-5-(2-(N-(2-fluoroethyl)acrylamido)ethoxy)pyrimidin-4-yl)-5-fluoro-2-methylphenyl)-4-cyclopropyl-2-fluorobenzamide; N-(3-(5-((1-Acrylamidocyclopropyl)methoxy)-6-aminopyrimidin-4-yl)-5-fluoro-2-methylphenyl)-4-cyclopropyl-2-fluorobenzamide; (S)-N-(3-(5-(2-Acrylamidopropoxy)-6-aminopyrimidin-4-yl)-5-fluoro-2-methylphenyl)-4-cyclopropyl-2-fluorobenzamide; (S)-N-(3-(6-Amino-5-(2-(but-2-ynamido)propoxy)pyrimidin-4-yl)-5-fluoro-2-methylphenyl)-4-cyclopropyl-2-fluorobenzamide; (S)-N-(3-(6-Amino-5-(2-(N-methylacrylamido)propoxy)pyrimidin-4-yl)-5-fluoro-2-methylphenyl)-4-cyclopropyl-2-fluorobenzamide; (S)-N-(3-(6-Amino-5-(2-(N-methylbut-2-ynamido)propoxy)pyrimidin-4-yl)-5-fluoro-2-methylphenyl)-4-cyclopropyl-2-fluorobenzamide; N-(3-(6-Amino-5-(3-(N-methylacrylamido)propoxy)pyrimidin-4-yl)-5-fluoro-2-methylphenyl)-4-cyclopropyl-2-fluorobenzamide; (S)-N-(3-(5-((1-Acryloylpyrrolidin-2-yl)methoxy)-6-aminopyrimidin-4-yl)-5-fluoro-2-methylphenyl)-4-cyclopropyl-2-fluorobenzamide; (S)-N-(3-(6-Amino-5-((1-(but-2-ynoyl)pyrrolidin-2-yl)methoxy)pyrimidin-4-yl)-5-fluoro-2-methylphenyl)-4-cyclopropyl-2-fluorobenzamide; (S)-2-(3-(5-((1-Acryloylpyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(2-((4-Amino-6-(3-(6-cyclopropyl-1-oxo-3,4-dihydroisoquinolin-2(1H)-yl)-5-fluoro-2-(hydroxymethyl)phenyl)pyrimidin-5-yl)oxy)ethyl)-N-methylacrylamide; N-(3-(5-(((2S,4R)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; 2-(3-(5-(((2S,4R)-1-Acryloyl-4-methoxypyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(3-(5-(((2S,4S)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4S)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; N-(3-(5-(((2S,4R)-1-Acryloyl-4-fluoropyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-fluoropyrrolidin-2-yl)methoxy)pyrimidin-4-yl)-5-fluoro-2-methylphenyl)-4-cyclopropyl-2-fluorobenzamide; (S)-N-(3-(5-((1-Acryloylazetidin-2-yl)methoxy)-6-aminopyrimidin-4-yl)-5-fluoro-2-methylphenyl)-4-cyclopropyl-2-fluorobenzamide; (S)-N-(3-(6-Amino-5-((1-propioloylazetidin-2-yl)methoxy)pyrimidin-4-yl)-5-fluoro-2-methylphenyl)-4-cyclopropyl-2-fluorobenzamide; (S)-2-(3-(5-((1-Acryloylazetidin-2-yl)methoxy)-6-aminopyrimidin-4-yl)-5-fluoro-2-(hydroxymethyl)phenyl)-6-cyclopropyl-3,4-dihydroisoquinolin-1(2H)-one; (R)-N-(3-(5-((1-Acryloylazetidin-2-yl)methoxy)-6-aminopyrimidin-4-yl)-5-fluoro-2-methylphenyl)-4-cyclopropyl-2-fluorobenzamide; (R)-N-(3-(5-((1-Acryloylpiperidin-3-yl)methoxy)-6-aminopyrimidin-4-yl)-5-fluoro-2-methylphenyl)-4-cyclopropyl-2-fluorobenzamide; N-(3-(5-(((2R,3S)-1-Acryloyl-3-methoxypyrrolidin-2-yl)methoxy)-6-aminopyrimidin-4-yl)-5-fluoro-2-methylphenyl)-4-cyclopropyl-2-fluorobenzamide; N-(3-(5-(((2S,4R)-1-Acryloyl-4-cyanopyrrolidin-2-yl)methoxy)-6-aminopyrimidin-4-yl)-5-fluoro-2-methylphenyl)-4-cyclopropyl-2-fluorobenzamide; or N-(3-(5-(((2S,4S)-1-Acryloyl-4-cyanopyrrolidin-2-yl)methoxy)-6-aminopyrimidin-4-yl)-5-fluoro-2-methylphenyl)-4-cyclopropyl-2-fluorobenzamide.

Unless otherwise provided, the chemical terms used above in describing the BTK inhibitor of Formula I are used according to their meanings as set out in International Application WO/2015/079417, which is herein incorporated by reference in its entirety.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-mmino-8-[trans-4-(2-hydroxyethoxy)cyclohexyl]-6-(6-methoxy-3-pyridinyl)-4-methylpyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 706), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

In embodiments, a CAR-expressing cell described herein is administered to a subject in combination with a phosphoinositide 3-kinase (PI3K) inhibitor (e.g., a PI3K inhibitor described herein, e.g., idelalisib or duvelisib) and/or rituximab. In embodiments, a CAR-expressing cell described herein is administered to a subject in combination with idelalisib and rituximab. In embodiments, a CAR-expressing cell described herein is administered to a subject in combination with duvelisib and rituximab. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

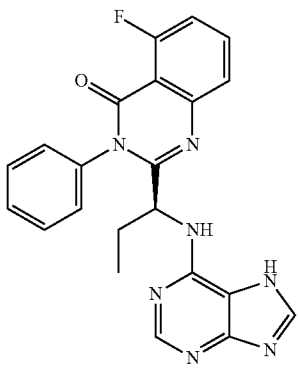 [SMILES: CC[C@H](Nc1ncnc2nc[nH]c12)c1nc2cccc(F)c2c(=O)n1-c1ccccc1]

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

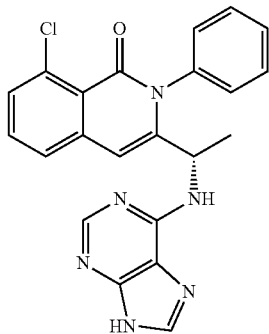 [SMILES: C[C@H](Nc1ncnc2[nH]cnc12)c1cc2cccc(Cl)c2c(=O)n1-c1ccccc1]

In embodiments, the subject has CLL. In embodiments, the subject has relapsed CLL, e.g., the subject has previously been administered a cancer therapy (e.g., previously been administered an anti-CD20 antibody or previously been administered ibrutinib). For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the subject has a deletion in the long arm of chromosome 11 (del(11q)). In other embodiments, the subject does not have a del(11q). In embodiments, idelalisib is administered at a dosage of about 100-400 mg (e.g., 100-125, 125-150, 150-175, 175-200, 200-225, 225-250, 250-275, 275-300, 325-350, 350-375, or 375-400 mg), e.g., BID. In embodiments, duvelisib is administered at a dosage of about 15-100 mg (e.g., about 15-25, 25-50, 50-75, or 75-100 mg), e.g., twice a day. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

In one embodiment, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl]phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl]phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In embodiments, a CAR-expressing cell described herein is administered to a subject in combination with an anaplastic lymphoma kinase (ALK) inhibitor. Exemplary ALK kinases include but are not limited to crizotinib (Pfizer), ceritinib (Novartis), alectinib (Chugai), brigatinib (also called AP26113; Ariad), entrectinib (Ignyta), PF-06463922 (Pfizer), TSR-011 (Tesaro) (see, e.g., Clinical Trial Identifier No. NCT02048488), CEP-37440 (Teva), and X-396 (Xcovery). In some embodiments, the subject has a solid cancer, e.g., a solid cancer described herein, e.g., lung cancer.

The chemical name of crizotinib is 3-[(1R)-1-(2,6-dichloro-3-fluorophenyl)ethoxy]-5-(1-piperidin-4-ylpyrazol-4-yl)pyridin-2-amine. The chemical name of ceritinib is 5-Chloro-N$^2$-[2-isopropoxy-5-methyl-4-(4-piperidinyl)phenyl]-N$^4$-[2-(isopropylsulfonyl)phenyl]-2,4-pyrimidinediamine. The chemical name of alectinib is 9-ethyl-6,6-dimethyl-8-(4-morpholinopiperidin-1-yl)-11-oxo-6,11-dihydro-5H-benzo[b]carbazole-3-carbonitrile. The chemical name of brigatinib is 5-Chloro-N$^2$-{4-[4-(dimethylamino)-1-piperidinyl]-2-methoxyphenyl}-N$^4$-[2-(dimethylphosphoryl)phenyl]-2,4-pyrimidinediamine. The chemical name of entrectinib is N-(5-(3,5-difluorobenzyl)-1H-indazol-3-yl)-4-(4- methylpiperazin-1-yl)-2-((tetrahydro-2H-pyran-4-yl)amino) benzamide. The chemical name of PF-06463922 is (10R)-7-Amino-12-fluoro-2,10,16-trimethyl-15-oxo-10,15,16,17-tetrahydro-2H-8,4-(metheno)pyrazolo[4,3-h][2,5,11]-benzoxadiazacyclotetradecine-3-carbonitrile. The chemical structure of CEP-37440 is (S)-2-((5-chloro-2-((6-(4-(2-hydroxyethyl)piperazin-1-yl)-1-methoxy-6,7,8,9-tetrahydro-5H-benzo[7]annulen-2-yl)amino)pyrimidin-4-yl)amino)-N-methylbenzamide. The chemical name of X-396 is (R)-6-amino-5-(1-(2,6-dichloro-3-fluorophenyl)ethoxy)-N-(4-(4-methylpiperazine-1-carbonyl)phenyl)pyridazine-3-carboxamide.

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In embodiments, a CAR-expressing cell described herein is administered to a subject in combination with an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. pDCs, macrophages, and dendritic cells (DCs) can express IDO. Without being bound by theory, it is thought that a decrease in L-tryptophan (e.g., catalyzed by IDO) results in an immunosuppressive milieu by inducing T-cell anergy and apoptosis. Thus, without being bound by theory, it is thought that an IDO inhibitor can enhance the efficacy of a CAR-expressing cell described herein, e.g., by decreasing the suppression or death of a CAR-expressing immune cell. In embodiments, the subject has a solid tumor, e.g., a solid tumor described herein, e.g., prostatic, colorectal, pancreatic, cervical, gastric, ovarian, head, or lung cancer. Exemplary inhibitors of IDO include but are not limited to 1-methyl-tryptophan, indoximod (NewLink Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255)

In embodiments, a CAR-expressing cell described herein is administered to a subject in combination with a modulator of myeloid-derived suppressor cells (MDSCs). MDSCs accumulate in the periphery and at the tumor site of many solid tumors. These cells suppress T cell responses, thereby hindering the efficacy of CAR-expressing cell therapy. Without being bound by theory, it is thought that administration of a MDSC modulator enhances the efficacy of a CAR-expressing cell described herein. In an embodiment, the subject has a solid tumor, e.g., a solid tumor described herein, e.g., glioblastoma. Exemplary modulators of MDSCs include but are not limited to MCS 110 and BLZ945. MCS 110 is a monoclonal antibody (mAb) against macrophage colony-stimulating factor (M-CSF). See, e.g., Clinical Trial Identifier No. NCT00757757. BLZ945 is a small molecule inhibitor of colony stimulating factor 1 receptor (CSF1R). See, e.g., Pyonteck et al. Nat. Med. 19(2013):1264-72. The structure of BLZ945 is shown below.

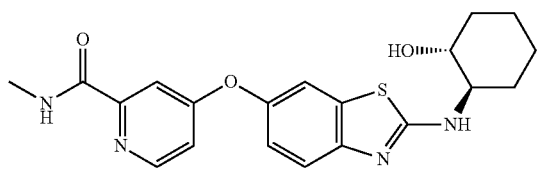 [SMILES: CNC(=O)c1cc(Oc2ccc3nc(N[C@@H]4CCCC[C@H]4O)sc3c2)ccn1]

In embodiments, a CAR-expressing cell described herein is administered to a subject in combination with an agent that inhibits or reduces the activity of immunosuppressive plasma cells. Immunosuppressive plasma cells have been shown to impede T cell-dependent immunogenic chemotherapy, such as oxaliplatin (Shalapour et al., Nature 2015, 521:94-101). In an embodiment, immunosuppressive plasma cells can express one or more of IgA, interleukin (IL)-10, and PD-L1. In an embodiment, the agent is a CD19 CAR-expressing cell or a BCMA CAR-expressing cell.

In some embodiments, a CAR-expressing cell described herein is administered to a subject in combination with a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15 (Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. In embodiments, het-IL-15 is administered subcutaneously. In embodiments, the subject has a cancer, e.g., solid cancer, e.g., melanoma or colon cancer. In embodiments, the subject has a metastatic cancer.

In embodiments, a subject having a disease described herein, e.g., a hematological disorder, e.g., AML or MDS, is administered a CAR-expressing cell described herein in combination with an agent, e.g., cytotoxic or chemotherapy agent, a biologic therapy (e.g., antibody, e.g., monoclonal antibody, or cellular therapy), or an inhibitor (e.g., kinase inhibitor). In embodiments, the subject is administered a CAR-expressing cell described herein in combination with a cytotoxic agent, e.g., CPX-351 (Celator Pharmaceuticals), cytarabine, daunorubicin, vosaroxin (Sunesis Pharmaceuticals), sapacitabine (Cyclacel Pharmaceuticals), idarubicin, or mitoxantrone. CPX-351 is a liposomal formulation comprising cytarabine and daunorubicin at a 5:1 molar ratio. In embodiments, the subject is administered a CAR-expressing cell described herein in combination with a hypomethylating agent, e.g., a DNA methyltransferase inhibitor, e.g., azacitidine or decitabine. In embodiments, the subject is administered a CAR-expressing cell described herein in combination with a biologic therapy, e.g., an antibody or cellular therapy, e.g., 225Ac-lintuzumab (Actimab-A; Actinium Pharmaceuticals), IPH2102 (Innate Pharma/Bristol Myers Squibb), SGN-CD33A (Seattle Genetics), or gemtuzumab ozogamicin (Mylotarg; Pfizer). SGN-CD33A is an antibody-drug conjugate (ADC) comprising a pyrrolobenzodiazepine dimer that is attached to an anti-CD33 antibody. Actimab-A is an anti-CD33 antibody (lintuzumab) labeled with actinium. IPH2102 is a monoclonal antibody that targets killer immunoglobulin-like receptors (KIRs). In embodiments, the subject is administered a CAR-expressing cell described herein in combination a FLT3 inhibitor, e.g., sorafenib (Bayer), midostaurin (Novartis), quizartinib (Daiichi Sankyo), crenolanib (Arog Pharmaceuticals), PLX3397 (Daiichi Sankyo), AKN-028 (Akinion Pharmaceuticals), or ASP2215 (Astellas). In embodiments, the subject is administered a CAR-expressing cell described herein in combination with an isocitrate dehydrogenase (IDH) inhibitor, e.g., AG-221 (Celgene/Agios) or AG-120 (Agios/Celgene). In embodiments, the subject is administered a CAR-expressing cell described herein in combination with a cell cycle regulator, e.g., inhibitor of polo-like kinase 1 (Plk1), e.g., volasertib (Boehringer Ingelheim); or an inhibitor of cyclin-dependent kinase 9 (Cdk9), e.g., alvocidib (Tolero Pharmaceuticals/Sanofi Aventis). In embodiments, the subject is administered a CAR-expressing cell described herein in combination with a B cell receptor signaling network inhibitor, e.g., an inhibitor of B-cell lymphoma 2 (Bcl-2), e.g., venetoclax (Abbvie/Roche); or an inhibitor of Bruton's tyrosine kinase (Btk), e.g., ibrutinib (Pharmacyclics/Johnson & Johnson Janssen Pharmaceutical). In embodiments, the subject is administered a CAR-expressing cell described herein in combination with an inhibitor of M1 aminopeptidase, e.g., tosedostat (CTI BioPharma/Vernalis); an inhibitor of histone deacetylase (HDAC), e.g., pracinostat (MEI Pharma); a multi-kinase inhibitor, e.g., rigosertib (Onconova Therapeutics/Baxter/SymBio); or a peptidic CXCR4 inverse agonist, e.g., BL-8040 (BioLineRx). In embodiments, the subject is administered a CD123-targeting CAR-expressing cell in combination with a CAR-expressing cell that targets an antigen other than CD123, e.g., CLL-1, BCMA, CD33, CD19, FLT-3, or folate receptor beta.

In another embodiment, the subjects receive an infusion of the CD123 CAR-expressing cell compositions of the present invention prior to transplantation, e.g., allogeneic stem cell transplant, of cells. In a preferred embodiment, CD123-CAR expressing cells transiently express CD123 CAR, e.g., by electroporation of an mRNA CD123 CAR, whereby the expression of the CD123 is terminated prior to infusion of donor stem cells to avoid engraftment failure.

Some patients may experience allergic reactions to the compounds of the present invention and/or other anti-cancer agent(s) during or after administration; therefore, anti-allergic agents are often administered to minimize the risk of an allergic reaction. Suitable anti-allergic agents include corticosteroids, such as dexamethasone (e.g., Decadron®), beclomethasone (e.g., Beclovent®), hydrocortisone (also known as cortisone, hydrocortisone sodium succinate, hydrocortisone sodium phosphate, and sold under the tradenames Ala-Cort®, hydrocortisone phosphate, Solu-Cortef®, Hydrocort Acetate® and Lanacort®), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-methylprednisolone, methylprednisolone acetate, methylprednisolone sodium succinate, sold under the tradenames Duralone®, Medralone®, Medrol®, M-Prednisol® and Solu-Medrol®); antihistamines, such as diphenhydramine (e.g., Benadryl®), hydroxyzine, and cyproheptadine; and bronchodilators, such as the beta-adrenergic receptor agonists, albuterol (e.g., Proventil®), and terbutaline (Brethine®).

Some patients may experience nausea during and after administration of the compound of the present invention and/or other anti-cancer agent(s); therefore, anti-emetics are used in preventing nausea (upper stomach) and vomiting. Suitable anti-emetics include aprepitant (Emend®), ondansetron (Zofran®), granisetron HCl (Kytril®), lorazepam (Ativan®. dexamethasone (Decadron®), prochlorperazine (Compazine®), casopitant (Rezonic® and Zunrisa®), and combinations thereof.

Medication to alleviate the pain experienced during the treatment period is often prescribed to make the patient more comfortable. Common over-the-counter analgesics, such Tylenol®, are often used. However, opioid analgesic drugs such as hydrocodone/paracetamol or hydrocodone/acetaminophen (e.g., Vicodin®), morphine (e.g., Astramorph® or Avinza®), oxycodone (e.g., OxyContin® or Percocet®), oxymorphone hydrochloride (Opana®), and fentanyl (e.g., Duragesic®) are also useful for moderate or severe pain.

In an effort to protect normal cells from treatment toxicity and to limit organ toxicities, cytoprotective agents (such as neuroprotectants, free-radical scavengers, cardioprotectors, anthracycline extravasation neutralizers, nutrients and the like) may be used as an adjunct therapy. Suitable cytoprotective agents include Amifostine (Ethyol®), glutamine, dimesna (Tavocept®), mesna (Mesnex®), dexrazoxane (Zinecard® or Totect®), xaliproden (Xaprila®), and leucovorin (also known as calcium leucovorin, citrovorum factor and folinic acid).

The structure of the active compounds identified by code numbers, generic or trade names may be taken from the actual edition of the standard compendium "The Merck Index" or from databases, e.g. Patents International (e.g. IMS World Publications).

The above-mentioned compounds, which can be used in combination with a compound of the present invention, can be prepared and administered as described in the art, such as in the documents cited above.

In one embodiment, the present invention provides pharmaceutical compositions comprising at least one compound of the present invention (e.g., a compound of the present invention) or a pharmaceutically acceptable salt thereof together with a pharmaceutically acceptable carrier suitable for administration to a human or animal subject, either alone or together with other anti-cancer agents.

In one embodiment, the present invention provides methods of treating human or animal subjects suffering from a cellular proliferative disease, such as cancer. The present invention provides methods of treating a human or animal subject in need of such treatment, comprising administering to the subject a therapeutically effective amount of a compound of the present invention (e.g., a compound of the present invention) or a pharmaceutically acceptable salt thereof, either alone or in combination with other anti-cancer agents.

In particular, compositions will either be formulated together as a combination therapeutic or administered separately.

In combination therapy, the compound of the present invention and other anti-cancer agent(s) may be administered either simultaneously, concurrently or sequentially with no specific time limits, wherein such administration provides therapeutically effective levels of the two compounds in the body of the patient.

In a preferred embodiment, the compound of the present invention and the other anti-cancer agent(s) is generally administered sequentially in any order by infusion or orally. The dosing regimen may vary depending upon the stage of the disease, physical fitness of the patient, safety profiles of the individual drugs, and tolerance of the individual drugs, as well as other criteria well-known to the attending physician and medical practitioner(s) administering the combination. The compound of the present invention and other anti-cancer agent(s) may be administered within minutes of each other, hours, days, or even weeks apart depending upon the particular cycle being used for treatment. In addition, the cycle could include administration of one drug more often than the other during the treatment cycle and at different doses per administration of the drug.

In another aspect of the present invention, kits that include one or more compound of the present invention and a combination partner as disclosed herein are provided. Representative kits include (a) a compound of the present invention or a pharmaceutically acceptable salt thereof, (b) at least one combination partner, e.g., as indicated above, whereby such kit may comprise a package insert or other labeling including directions for administration.

A compound of the present invention may also be used to advantage in combination with known therapeutic processes, for example, the administration of hormones or especially radiation. A compound of the present invention may in particular be used as a radiosensitizer, especially for the treatment of tumors which exhibit poor sensitivity to radiotherapy.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardiac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. CRS may include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others.

In some embodiments, the subject is administered a vasopressor, such as, e.g., norepinephrine, dopamine, phenylephrine, epinephrine, vasopressin, or a combination thereof.

In an embodiment, the subject can be administered an antipyretic agent. In an embodiment, the subject can be administered an analgesic agent.

In one embodiment, the subject can be administered an agent which enhances the activity of a CAR-expressing cell. For example, in one embodiment, the agent can be an agent which inhibits an inhibitory molecule, e.g., the agent is a checkpoint inhibitor. Inhibitory molecules, e.g., Programmed Death 1 (PD1), can, in some embodiments, decrease the ability of a CAR-expressing cell to mount an immune effector response. Examples of inhibitory molecules include PD1, PD-L1, CTLA4, TIM3, LAG3, VISTA, BTLA, TIGIT, LAIR1, CD160, 2B4 and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR.

In an embodiment, a nucleic acid molecule that encodes a dsRNA molecule that inhibits expression of the molecule that modulates or regulates, e.g., inhibits, T-cell function is operably linked to a promoter, e.g., a H1- or a U6-derived promoter such that the dsRNA molecule that inhibits expression of the molecule that modulates or regulates, e.g., inhibits, T-cell function is expressed, e.g., is expressed within a CAR-expressing cell. See e.g., Tiscornia G., "Development of Lentiviral Vectors Expressing siRNA," Chapter 3, in *Gene Transfer: Delivery and Expression of DNA and RNA* (eds. Friedmann and Rossi). Cold Spring Harbor Laboratory Press, Cold Spring Harbor, N.Y., USA, 2007; Brummelkamp T R, et al. (2002) *Science* 296: 550-553; Miyagishi M, et al. (2002) *Nat. Biotechnol.* 19: 497-500. In an embodiment the nucleic acid molecule that encodes a dsRNA molecule that inhibits expression of the molecule that modulates or regulates, e.g., inhibits, T-cell function is present on the same vector, e.g., a lentiviral vector, that comprises a nucleic acid molecule that encodes a component, e.g., all of the components, of the CAR. In such an embodiment, the nucleic acid molecule that encodes a dsRNA molecule that inhibits expression of the molecule that modulates or regulates, e.g., inhibits, T-cell function is located on the vector, e.g., the lentiviral vector, 5'- or 3'- to the nucleic acid that encodes a component, e.g., all of the components, of the CAR. The nucleic acid molecule that encodes a dsRNA molecule that inhibits expression of the molecule that modulates or regulates, e.g., inhibits, T-cell function can be transcribed in the same or different direction as the nucleic acid that encodes a component, e.g., all of the components, of the CAR.

In an embodiment the nucleic acid molecule that encodes a dsRNA molecule that inhibits expression of the molecule that modulates or regulates, e.g., inhibits, T-cell function is present on a vector other than the vector that comprises a nucleic acid molecule that encodes a component, e.g., all of the components, of the CAR. In an embodiment, the nucleic acid molecule that encodes a dsRNA molecule that inhibits expression of the molecule that modulates or regulates, e.g., inhibits, T-cell function it transiently expressed within a CAR-expressing cell. In an embodiment, the nucleic acid molecule that encodes a dsRNA molecule that inhibits expression of the molecule that modulates or regulates, e.g., inhibits, T-cell function is stably integrated into the genome of a CAR-expressing cell. FIGS. 51A-51E depicts examples of vectors for expressing a component, e.g., all of the components, of the CAR with a dsRNA molecule that inhibits expression of the molecule that modulates or regulates, e.g., inhibits, T-cell function.

Examples of dsRNA molecules useful for inhibiting expression of a molecule that modulates or regulates, e.g., inhibits, T-cell function, wherein the molecule that modulates or regulates, e.g., inhibits, T-cell function is PD-1 are provided below.

Provided in Table 16 below are the names of PDCD1 (PD1) RNAi agents (derived from their position in the mouse PDCD1 gene sequence NM_008798.2), along with the SEQ ID NOs: 216-263 representing the DNA sequence. Both sense (S) and antisense (AS) sequences are presented as 19mer and 21mer sequences are in this table. Also note that the position (PoS, e.g., 176) is derived from the position number in the mouse PDCD1 gene sequence NM_008798.2. SEQ ID NOs are indicated in groups of 12 that correspond with "sense 19" SEQ ID NOs: 608-619; "sense 21" SEQ ID NOs: 620-631; "asense 21" SEQ ID NOs: 632-643; "asense 19" SEQ ID NOs: 644-655.

TABLE 16

Mouse PDCD1 (PD1) shRNA sequences

| Position on NM_008798.2 | Target region | Sense19 | Sense21 | Asense21 | Asense19 |
|---|---|---|---|---|---|
| 176 | CDS | GGAGGTCCCTC ACCTTCTA (SEQ ID NO: 608) | CTGGAGGTCCC TCACCTTCTA (SEQ ID NO: 620) | TAGAAGGTGAG GGACCTCCAG (SEQ ID NO: 632) | TAGAAGGTGAG GGACCTCC (SEQ ID NO: 644) |
| 260 | CDS | CGGAGGATCTT ATGCTGAA (SEQ ID NO: 609) | GTCGGAGGATC TTATGCTGAA (SEQ ID NO: 621) | TTCAGCATAAG ATCCTCCGAC (SEQ ID NO: 633) | TTCAGCATAAG ATCCTCCG (SEQ ID NO: 645) |
| 359 | CDS | CCCGCTTCCAG ATCATACA (SEQ ID NO: 610) | TGCCCGCTTCC AGATCATACA (SEQ ID NO: 622) | TGTATGATCTG GAAGCGGGCA (SEQ ID NO: 634) | TGTATGATCTG GAAGCGGG (SEQ ID NO: 646) |
| 528 | CDS | GGAGACCTCAA CAAGATAT (SEQ ID NO: 611) | CTGGAGACCTC AACAAGATAT (SEQ ID NO: 623) | ATATCTTGTTGA GGTCTCCAG (SEQ ID NO: 635) | ATATCTTGTTG AGGTCTCC (SEQ ID NO: 647) |
| 581 | CDS | AAGGCATGGTC ATTGGTAT (SEQ ID NO: 612) | TCAAGGCATGG TCATTGGTAT (SEQ ID NO: 624) | ATACCAATGAC CATGCCTTGA (SEQ ID NO: 636) | ATACCAATGAC CATGCCTT (SEQ ID NO: 648) |
| 584 | CDS | GCATGGTCATT GGTATCAT (SEQ ID NO: 613) | AGGCATGGTCA TTGGTATCAT (SEQ ID NO: 625) | ATGATACCAAT GACCATGCCT (SEQ ID NO: 637) | ATGATACCAAT GACCATGC (SEQ ID NO: 649) |
| 588 | CDS | GGTCATTGGTA TCATGAGT (SEQ ID NO: 614) | ATGGTCATTGG TATCATGAGT (SEQ ID NO: 626) | ATGGTCATTGG TATCATGAGT (SEQ ID NO: 638) | ATGGTCATTGG TATCATGA (SEQ ID NO: 650) |
| 609 | CDS | CCTAGTGGGTA TCCCTGTA (SEQ ID NO: 615) | GCCCTAGTGGG TATCCCTGTA (SEQ ID NO: 627) | GCCCTAGTGGG TATCCCTGTA (SEQ ID NO: 639) | GCCCTAGTGGG TATCCCTG (SEQ ID NO: 651) |
| 919 | CDS | GAGGATGGACA TTGTTCTT (SEQ ID NO: 616) | ATGAGGATGGA CATTGTTCTT (SEQ ID NO: 628) | ATGAGGATGGA CATTGTTCTT (SEQ ID NO: 640) | ATGAGGATGGA CATTGTTC (SEQ ID NO: 652) |
| 1021 | 3'UTR | GCATGCAGGCT ACAGTTCA (SEQ ID NO: 617) | GAGCATGCAGG CTACAGTTCA (SEQ ID NO: 629) | GAGCATGCAGG CTACAGTTCA (SEQ ID NO: 641) | GAGCATGCAGG CTACAGTT (SEQ ID NO: 653) |
| 1097 | 3'UTR | CCAGCACATGC ACTGTTGA (SEQ ID NO: 618) | TTCCAGCACAT GCACTGTTGA (SEQ ID NO: 630) | TTCCAGCACAT GCACTGTTGA (SEQ ID NO: 642) | TTCCAGCACAT GCACTGTT (SEQ ID NO: 654) |

TABLE 16 -continued

Mouse PDCD1 (PD1) shRNA sequences

| Position on NM_008798.2 | Target region | Sense19 | Sense21 | Asense21 | Asense19 |
|---|---|---|---|---|---|
| 1101 | 3'UTR | CACATGCACTG TTGAGTGA (SEQ ID NO: 619) | AGCACATGCAC TGTTGAGTGA (SEQ ID NO: 631) | AGCACATGCAC TGTTGAGTGA (SEQ ID NO: 643) | AGCACATGCAC TGTTGAGT (SEQ ID NO: 655) |

Provided in Table 17 below are the names of PDCD1 (PD1) RNAi agents (derived from their position in the human PDCD1 gene sequence, along with the SEQ ID NOs. 264-311 representing the DNA sequence. Both sense (S) and antisense (AS) sequences are presented as 19mer and 21mer sequences. SEQ ID NOs are indicated in groups of 12 that correspond with "sense 19" SEQ ID NOs: 656-667; "sense 21" SEQ ID NOs: 668-679; "asense 21" SEQ ID NOs: 680-691; "asense 19" SEQ ID NOs: 692-703.

TABLE 17

Human PDCD1 (PD1) shRNA sequences

| Position on NM_005018.2 | Target region | Sense19 | Asense19 | Sense21 | Asense21 |
|---|---|---|---|---|---|
| 145 | CDS | GGCCAGGATGG TTCTTAGA (SEQ ID NO: 656) | TCTAAGAACCA TCCTGGCC (SEQ ID NO: 668) | GCGGCCAGGAT GGTTCTTAGA (SEQ ID NO: 680) | TCTAAGAACCA TCCTGGCCGC (SEQ ID NO: 692) |
| 271 | CDS | GCTTCGTGCTA AACTGGTA (SEQ ID NO: 657) | TACCAGTTTAG CACGAAGC (SEQ ID NO: 669) | GAGCTTCGTGC TAAACTGGTA (SEQ ID NO: 681) | TACCAGTTTAG CACGAAGCTC (SEQ ID NO: 693) |
| 393 | CDS | GGGCGTGACTT CCACATGA (SEQ ID NO: 658) | TCATGTGGAAG TCACGCCC (SEQ ID NO: 670) | ACGGGCGTGAC TTCCACATGA (SEQ ID NO: 682) | TCATGTGGAAG TCACGCCCGT (SEQ ID NO: 694) |
| 1497 | 3'UTR | CAGGCCTAGAG AAGTTTCA (SEQ ID NO: 659) | TGAAACTTCTC TAGGCCTG (SEQ ID NO: 671) | TGCAGGCCTAG AGAAGTTTCA (SEQ ID NO: 683) | TGAAACTTCTC TAGGCCTGCA (SEQ ID NO: 695) |
| 1863 | 3'UTR | CTTGGAACCCA TTCCTGAA (SEQ ID NO: 660) | TTCAGGAATGG GTTCCAAG (SEQ ID NO: 672) | TCCTTGGAACC CATTCCTGAA (SEQ ID NO: 684) | TTCAGGAATGG GTTCCAAGGA (SEQ ID NO: 696) |
| 1866 | 3'UTR | GGAACCCATTC CTGAAATT (SEQ ID NO: 661) | AATTTCAGGAA TGGGTTCC (SEQ ID NO: 673) | TTGGAACCCAT TCCTGAAATT (SEQ ID NO: 685) | AATTTCAGGAA TGGGTTCCAA (SEQ ID NO: 697) |
| 1867 | 3'UTR | GAACCCATTCC TGAAATTA (SEQ ID NO: 662) | TAATTTCAGGA ATGGGTTC (SEQ ID NO: 674) | TGGAACCCATT CCTGAAATTA (SEQ ID NO: 686) | TAATTTCAGGA ATGGGTTCCA (SEQ ID NO: 698) |
| 1868 | 3'UTR | AACCCATTCCT GAAATTAT (SEQ ID NO: 663) | ATAATTTCAGG AATGGGTT (SEQ ID NO: 675) | GGAACCCATTC CTGAAATTAT (SEQ ID NO: 687) | ATAATTTCAGG AATGGGTTCC (SEQ ID NO: 699) |
| 1869 | 3'UTR | ACCCATTCCTG AAATTATT (SEQ ID NO: 664) | AATAATTTCAG GAATGGGT (SEQ ID NO: 676) | GAACCCATTCC TGAAATTATT (SEQ ID NO: 688) | AATAATTTCAG GAATGGGTTC (SEQ ID NO: 700) |
| 1870 | 3'UTR | CCCATTCCTGA AATTATTT (SEQ ID NO: 665) | AAATAATTTCA GGAATGGG (SEQ ID NO: 677) | AACCCATTCCT GAAATTATTT (SEQ ID NO: 689) | AAATAATTTCA GGAATGGGTT (SEQ ID NO: 701) |
| 2079 | 3'UTR | CTGTGGTTCTAT TATATTA (SEQ ID NO: 666) | TAATATAATAG AACCACAG (SEQ ID NO: 678) | CCCTGTGGTTCT ATTATATTA (SEQ ID NO: 690) | TAATATAATAG AACCACAGGG (SEQ ID NO: 702) |

TABLE 17 -continued

Human PDCD1 (PD1) shRNA sequences

| Position on NM_005018.2 | Target region | Sense19 | Asense19 | Sense21 | Asense21 |
|---|---|---|---|---|---|
| 2109 | 3'UTR | AAATATGAGAGCATGCTAA (SEQ ID NO: 667) | TTAGCATGCTCTCATATTT (SEQ ID NO: 679) | TTAAATATGAGAGCATGCTAA (SEQ ID NO: 691) | TTAGCATGCTCTCATATTTAA (SEQ ID NO: 703) |

In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In embodiments, the agent that enhances the activity of a CAR-expressing cell, e.g., inhibitor of an inhibitory molecule, is administered in combination with an allogeneic CAR, e.g., an allogeneic CAR described herein (e.g., described in the Allogeneic CAR section herein).

PD-1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD-1, PD-L1 and PD-L2 have been shown to downregulate T cell activation upon binding to PD-1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD-1 with PD-L1.

Antibodies, antibody fragments, and other inhibitors of PD-1, PD-L1 and PD-L2 are available in the art and may be used combination with a cars of the present invention described herein. For example, nivolumab (also referred to as BMS-936558 or MDX1106; Bristol-Myers Squibb) is a fully human IgG4 monoclonal antibody which specifically blocks PD-1. Nivolumab (clone 5C4) and other human monoclonal antibodies that specifically bind to PD-1 are disclosed in U.S. Pat. No. 8,008,449 and WO2006/121168. Pidilizumab (CT-011; Cure Tech) is a humanized IgG1k monoclonal antibody that binds to PD-1. Pidilizumab and other humanized anti-PD-1 monoclonal antibodies are disclosed in WO2009/101611. Pembrolizumab (formerly known as lambrolizumab, and also referred to as MK03475; Merck) is a humanized IgG4 monoclonal antibody that binds to PD-1. Pembrolizumab and other humanized anti-PD-1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD-1 and B7-H1. Other anti-PD-1 antibodies include AMP 514 (Amplimmune), among others, e.g., anti-PD-1 antibodies disclosed in U.S. Pat. No. 8,609,089, US 2010028330, and/or US 20120114649.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1, or a sequence substantially identical (e.g., at least 80%, 85%, 90%, 92%, 95%, 97%, 98%, 99% or higher identical) to any of the aforesaid sequences; or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences.

TIM3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Ga19), phosphotidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety. In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. PLoS One. 2010 Sep. 2; 5(9). pii: e12529 (DOI: 10:1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. J Immunol. 2002 Mar. 15; 168(6): 2803-10; Markel et al. J Immunol. 2006 Nov. 1; 177(9): 6062-71; Markel et al. Immunology. 2009 February; 126(2): 186-200; Markel et al. Cancer Immunol Immunother. 2010 February; 59(2):215-30; Ortenberg et al. Mol Cancer Ther. 2012 June; 11(6):1300-10; Stern et al. J Immunol. 2005 Jun. 1; 174(11):6692-701; Zheng et al. PLoS One. 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) Nature doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 CAR described herein. For example, BMS-986016 (Bristol-Myers Squib) is a monoclonal antibody that targets LAG3. IMP701 (Imrnutep) is an antagonist LAG3 antibody and IMP731 (Immutep and GlaxoSmithKline) is depleting LAG3 antibody. Other LAG3 inhibitors include IMP321 (Immutep), which is a recombinant fusion protein of a soluble portion of LAG3 and Ig that binds to WIC class ii molecules and activates antigen presenting cells (APC). Other antibodies are disclosed, e.g., in WO2010/019570.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an antracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell that does not express a CD123 CAR.

In one embodiment, the agent which enhances activity of a CAR-expressing cell described herein is miR-17-92.

In one embodiment, the agent which enhances activity of a CAR-described herein is a cytokine. Cytokines have important functions related to T cell expansion, differentiation, survival, and homeostatis. Cytokines that can be administered to the subject receiving a CAR-expressing cell described herein include: IL-2, IL-4, IL-7, IL-9, IL-15, IL-18, and IL-21, or a combination thereof. In preferred embodiments, the cytokine administered is IL-7, IL-15, or IL-21, or a combination thereof. The cytokine can be administered once a day or more than once a day, e.g., twice a day, three times a day, or four times a day. The cytokine can be administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days.

In embodiments, the cytokine is administered in combination with CAR-expressing T cells. The cytokine can be administered simultaneously or concurrently with the CAR-expressing T cells, e.g., administered on the same day. The cytokine may be prepared in the same pharmaceutical composition as the CAR-expressing T cells, or may be prepared in a separate pharmaceutical composition. Alternatively, the cytokine can be administered shortly after administration of the CAR-expressing T cells, e.g., 1 day, 2 days, 3 days, 4 days, 5 days, 6 days, or 7 days after administration of the CAR-expressing T cells. In embodiments where the cytokine is administered in a dosing regimen that occurs over more than one day, the first day of the cytokine dosing regimen can be on the same day as administration with the CAR-expressing T cells, or the first day of the cytokine dosing regimen can be 1 day, 2 days, 3 days, 4 days, 5 days, 6 days, or 7 days after administration of the CAR-expressing T cells. In one embodiment, on the first day, the CAR-expressing T cells are administered to the subject, and on the second day, a cytokine is administered once a day for the next 7 days. In a preferred embodiment, the cytokine to be administered in combination with CAR-expressing T cells is IL-7, IL-15, or IL-21.

In other embodiments, the cytokine is administered a period of time after administration of CAR-expressing cells, e.g., at least 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells. In one embodiment, the cytokine is administered after assessment of the subject's response to the CAR-expressing cells. For example, the subject is administered CAR-expressing cells according to the dosage and regimens described herein. The response of the subject to CAR-expressing cell therapy is assessed at 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells, using any of the methods described herein, including inhibition of tumor growth, reduction of circulating tumor cells, or tumor regression. Subjects that do not exhibit a sufficient response to CAR-expressing cell therapy can be administered a cytokine. Administration of the cytokine to the subject that has sub-optimal response to the CAR-expressing cell therapy improves CAR-expressing cell efficacy or anti-cancer activity. In a preferred embodiment, the cytokine administered after administration of CAR-expressing cells is IL-7.

Combination with CD19 Inhibitors

The methods and compositions disclosed herein can be used in combination with a CD19 inhibitor. In some embodiments, the CD123CAR-containing cells and the CD19 inhibitor (e.g., one or more cells that express a CAR molecule that binds CD19, e.g., a CAR molecule that binds CD19 described herein) are administered simultaneously or concurrently, or sequentially.

In some embodiments, the CD123CAR-containing cells and the CD19 inhibitor are infused into a subject simultaneously or concurrently, e.g., are admixed in the same infusion volume. For example, a population of CD123CAR-containing cells and CD19CAR-containing cells are mixed together. Alternatively, a population of cells co-expressing a CD123CAR and a CD19CAR is administered. In other embodiments, the simultaneous administration comprises separate administration of the CD123CAR-containing cells and the CD19 inhibitor, e.g., within a predetermined time interval (e.g., within 15, 30, or 45 minutes of each other).

In some embodiments, the start of the CD123CAR-containing cells and the start of the CD19 inhibitor are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the end of the CD123CAR-containing cells delivery and the end of the CD19 inhibitor delivery are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the overlap in terms of administration between the end of the CD123CAR-containing cells delivery (e.g., infusion) and the end of CD19 inhibitor delivery (e.g., infusion) is at least 1, 2, 3, 4, 5, 10, 15, 20, 25, 30 minutes. In one embodiment, the CD19 inhibitor is administered prior to the CD123CAR-containing cells. In other embodiments, the CD123CAR-containing cells are administered prior to the CD19 inhibitor.

In some embodiments, the CD123CAR-containing cells are administered while the CD19 inhibitor (e.g., one or more cells that express a CD19CAR molecule) is present (e.g., cells undergoing expansion) in the subject. In other embodiments, the CD19 inhibitor (e.g., one or more cells that express a CD19CAR molecule) is administered while the CD123CAR-containing cells are present (e.g., cells undergoing expansion) in the subject.

A CD19 inhibitor includes, but is not limited to, a CD19 CAR-expressing cell, e.g., a CD19 CART cell, or an anti-CD19 antibody (e.g., an anti-CD19 mono- or bispecific antibody) or a fragment or conjugate thereof.

In one embodiment, a CAR-expressing cell described herein is administered to a subject in combination with a CD19 CAR-cell (e.g., CART cell) (e.g., CTL019, e.g., as described in WO2012/079000, incorporated herein by reference).

In other embodiments, the CAR-expressing cell described herein is administered to a subject in combination with a CD19 CAR-cell (e.g., CART cell) that includes a humanized antigen binding domain as described in WO2014/153270 (e.g., Table 3 of WO2014/153270), incorporated herein by reference.

The CD19 inhibitor (e.g., a first CD19 CAR-expressing cell) and a second CD123 CAR-expressing cell may be expressed by the same cell type or different types. For instance, in some embodiments, the cell expressing a CD19 CAR is a CD4+ T cell and the cell expressing a CD123 CAR is a CD8+ T cell, or the cell expressing a CD19 CAR is a CD8+ T cell and the cell expressing a CD123 CAR is a CD4+ T cell. In other embodiments, the cell expressing a CD19 CAR is a T cell and the cell expressing a CD123 CAR is a NK cell, or the cell expressing a CD19 CAR is a NK cell and the cell expressing a CD123 CAR is a T cell. In other embodiments, the cell expressing a CD19 CAR and the cell expressing a CD123 CAR are both NK cells or are both T cells, e.g., are both CD4+ T cells, or are both CD8+ T cells. In yet other embodiments, a single cell expresses the CD19 CAR and CD123 CAR, and this cell is, e.g., a NK cell or a T cell such as a CD4+ T cell or CD8+ T cell.

The first CAR and second CAR can comprise the same or different intracellular signaling domains. For instance, in some embodiments, the CD19 CAR comprises a CD3 zeta signaling domain and the CD123 CAR comprises a costimulatory domain, e.g., a 41BB, CD27 or CD28 costimulatory domain, while in some embodiments, the CD19 CAR comprises a costimulatory domain, e.g., a 41BB, CD27 or CD28 costimulatory domain and the CD123 CAR comprises a CD3 zeta signaling domain. In other embodiments, each of the CD19 CAR and the CD123 CAR comprises the same type of primary signaling domain, e.g., a CD3 zeta signaling domain, but the CD19 CAR and the CD123 CAR comprise different costimulatory domains, e.g., (1) the CD19 CAR comprises a 41BB costimulatory domain and the CD123 CAR comprises a different costimulatory domain e.g., a CD27 costimulatory domain, (2) the CD19 CAR comprises a CD27 costimulatory domain and the CD123 CAR comprises a different costimulatory domain e.g., a 41BB costimulatory domain, (3) the CD19 CAR comprises a 41BB costimulatory domain and the CD123 CAR comprises a CD28 costimulatory domain, (4) the CD19 CAR comprises a CD28 costimulatory domain and the CD123 CAR comprises a different costimulatory domain e.g., a 41BB costimulatory domain, (5) the CD19 CAR comprises a CD27 costimulatory domain and the CD123 CAR comprises a CD28 costimulatory domain, or (6) the CD19 CAR comprises a CD28 costimulatory domain and the CD123 CAR comprises a CD27 costimulatory domain. In another embodiment, a cell comprises a CAR that comprises both a CD19 antigen-binding domain and a CD123 antigen-binding domain, e.g., a bispecific antibody.

In embodiments, the subject has acute myeloid leukemia (AML), e.g., a CD19 positive AML or a CD19 negative AML. In embodiments, the subject has a CD19+ lymphoma, e.g., a CD19+ Non-Hodgkin's Lymphoma (NHL), a CD19+ FL, or a CD19+ DLBCL. In embodiments, the subject has a relapsed or refractory CD19+ lymphoma. In embodiments, a lymphodepleting chemotherapy is administered to the subject prior to, concurrently with, or after administration (e.g., infusion) of CD19 CART cells. In an example, the lymphodepleting chemotherapy is administered to the subject prior to administration of CD19 CART cells. For example, the lymphodepleting chemotherapy ends 1-4 days (e.g., 1, 2, 3, or 4 days) prior to CD19 CART cell infusion. In embodiments, multiple doses of CD19 CART cells are administered, e.g., as described herein. For example, a single dose comprises about $5\times10^8$ CD19 CART cells. In embodiments, a lymphodepleting chemotherapy is administered to the subject prior to, concurrently with, or after administration (e.g., infusion) of a CAR-expressing cell described herein, e.g., a non-CD19 CAR-expresing cell. In embodiments, a CD19 CART is administered to the subject prior to, concurrently with, or after administration (e.g., infusion) of a non-CD19 CAR-expressing cell, e.g., a non-CD19 CAR-expressing cell described herein.

In some embodiments, a CAR-expressing cell described herein is administered to a subject in combination with a CD19 CAR-expressing cell, e.g., CTL019, e.g., as described in WO2012/079000, incorporated herein by reference, for treatment of a disease associated with the expression of CD123, e.g., a cancer described herein. Without being bound by theory, it is believed that administering a CD19 CAR-expressing cell in combination with a CAR-expressing cell improves the efficacy of a CAR-expressing cell described herein by targeting early lineage cancer cells, e.g., cancer stem cells, modulating the immune response, depleting regulatory B cells, and/or improving the tumor microenvironment. For example, a CD19 CAR-expressing cell targets cancer cells that express early lineage markers, e.g., cancer stem cells and CD19-expressing cells, while the CAR-expressing cell described herein targets cancer cells that express later lineage markers, e.g., CD123. This preconditioning approach can improve the efficacy of the CAR-expressing cell described herein. In such embodiments, the CD19 CAR-expressing cell is administered prior to, concurrently with, or after administration (e.g., infusion) of a CAR-expressing cell described herein.

In embodiments, a CAR-expressing cell described herein also expresses a CAR targeting CD19, e.g., a CD19 CAR. In an embodiment, the cell expressing a CAR described herein and a CD19 CAR is administered to a subject for treatment of a cancer described herein, e.g., AML. In an embodiment, the configurations of one or both of the CAR molecules comprise a primary intracellular signaling domain and a costimulatory signaling domain. In another embodiment, the configurations of one or both of the CAR molecules comprise a primary intracellular signaling domain and two or more, e.g., 2, 3, 4, or 5 or more, costimulatory signaling domains. In such embodiments, the CAR molecule described herein and the CD19 CAR may have the same or a different primary intracellular signaling domain, the same or different costimulatory signaling domains, or the same number or a different number of costimulatory signaling domains. Alternatively, the CAR described herein and the CD19 CAR are configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

In an embodiment, the CAR described herein and the second CAR, e.g., CD19 CAR, are on the same vector or are on two different vectors. In embodiments where the CAR described herein and the second CAR, e.g., CD19 CAR, are on the same vector, the nucleic acid sequences encoding the CAR described herein and the second CAR, e.g., CD19 CAR are in the same frame, and are separated by one or more peptide cleavage sites, e.g., P2A.

In other embodiments, the CAR-expressing cell disclosed herein is administered in combination with an anti-CD19 antibody inhibitor. In one embodiment, the anti-CD19 antibody is a humanized antigen binding domain as described in WO2014/153270 (e.g., Table 3 of WO2014/153270) incorporated herein by reference, or a conjugate thereof. Other exemplary anti-CD19 antibodies or fragments or conjugates thereof, include but are not limited to, blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77. Blinatomomab is a bispecific antibody comprised of two scFvs—one that binds to CD19 and one that binds to CD3. Blinatomomab directs T cells to attack cancer cells. See, e.g., Hammer et al.; Clinical Trial Identifier No. NCT00274742 and NCT01209286. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No.

NCT01957579. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12(2009):936-41; Schindler et al. Br. J. Haematol. 154.4(2011):471-6. DT2219ARL is a bispecific immunotoxin targeting CD19 and CD22, comprising two scFvs and a truncated diphtheria toxin. See, e.g., Hammer et al.; and Clinical Trial Identifier No. NCT00889408. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. SAR3419 is an anti-CD19 antibody-drug conjugate (ADC) comprising an anti-CD19 humanized monoclonal antibody conjugated to a maytansine derivative via a cleavable linker. See, e.g., Younes et al, J. Clin. Oncol, 30.2(2012): 2776-82; Hammer et al.; Clinical Trial Identifier No. NCT00549185: and Blanc et al. Clin Cancer Res. 2011; 17:6448-58. XmAb-5871 is an Fc-engineered, humanized anti-CD19 antibody. See, e.g., Hammer et al. MDX-1342 is a human Fc-engineered anti-CD19 antibody with enhanced ADCC. See, e.g., Hammer et al. In embodiments, the antibody molecule is a bispecific anti-CD19 and anti-CD3 molecule. For instance, AFM11 is a bispecific antibody that targets CD19 and CD3. See, e.g., Hammer et al.; and Clinical Trial Identifier No. NCT02106091. In some embodiments, an anti-CD19 antibody described herein is conjugated or otherwise bound to a therapeutic agent, e.g., a chemotherapeutic agent, peptide vaccine (such as that described in Izumoto et al. 2008 J Neurosurg 108:963-971), immunosuppressive agent, or immunoablative agent, e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

Combination with a Low Dose of an mTOR Inhibitor

Methods described herein use low, immune enhancing, doses of mTOR inhibitors, e.g., allosteric mTOR inhibitors, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/01240036, hereby incorporated by reference.

In an embodiment, administration of a low, immune enhancing, dose of an mTOR inhibitor can result in one or more of the following:
  i) a decrease in the number of PD-1 positive immune effector cells;
  ii) an increase in the number of PD-1 negative immune effector cells;
  iii) an increase in the ratio of PD-1 negative immune effector cells/PD-1 positive immune effector cells;
  iv) an increase in the number of naive T cells;
  v) an increase in the expression of one or more of the following markers: $CD62L^{high}$, $CD127^{high}$, $CD27^+$, and BCL2, e.g., on memory T cells, e.g., memory T cell precursors;
  vi) a decrease in the expression of KLRG1, e.g., on memory T cells, e.g., memory T cell precursors; or
  vii) an increase in the number of memory T cell precursors, e.g., cells with any one or combination of the following characteristics: increased $CD62L^{high}$ increased $CD127^{high}$, increased $CD27^+$, decreased KLRG1, and increased BCL2;

and wherein any of the foregoing, e.g., i), ii), iii), iv), v), vi), or vii), occurs e.g., at least transiently, e.g., as compared to a non-treated subject.

In another embodiment, administration of a low, immune enhancing, dose of an mTOR inhibitor results in increased or prolonged proliferation of CAR-expressing cells, e.g., in culture or in a subject, e.g., as compared to non-treated CAR-expressing cells or a non-treated subject. In embodiments, increased proliferation is associated with in an increase in the number of CAR-expressing cells. Methods for measuring increased or prolonged proliferation are described in Examples 9 and 10. In another embodiment, administration of a low, immune enhancing, dose of an mTOR inhibitor results in increased killing of cancer cells by CAR-expressing cells, e.g., in culture or in a subject, e.g., as compared to non-treated CAR-expressing cells or a non-treated subject. In embodiments, increased killing of cancer cells is associated with in a decrease in tumor volume. Methods for measuring increased killing of cancer cells are described in Example 2.

In one embodiment, the cells expressing a CAR molecule, e.g., a CAR molecule described herein, are administered in combination with a low, immune enhancing dose of an mTOR inhibitor, e.g., an allosteric mTOR inhibitor, e.g., RAD001, or a catalytic mTOR inhibitor. For example, administration of the low, immune enhancing, dose of the mTOR inhibitor can be initiated prior to administration of a CAR-expressing cell described herein; completed prior to administration of a CAR-expressing cell described herein; initiated at the same time as administration of a CAR-expressing cell described herein; overlapping with administration of a CAR-expressing cell described herein; or continuing after administration of a CAR-expressing cell described herein.

Alternatively or in addition, administration of a low, immune enhancing, dose of an mTOR inhibitor can optimize immune effector cells to be engineered to express a CAR molecule described herein. In such embodiments, administration of a low, immune enhancing, dose of an mTOR inhibitor, e.g., an allosteric inhibitor, e.g., RAD001, or a catalytic inhibitor, is initiated or completed prior to harvest of immune effector cells, e.g., T cells or NK cells, to be engineered to express a CAR molecule described herein, from a subject.

In another embodiment, immune effector cells, e.g., T cells or NK cells, to be engineered to express a CAR molecule described herein, e.g., after harvest from a subject, or CAR-expressing immune effector cells, e.g., T cells or NK cells, e.g., prior to administration to a subject, can be cultured in the presence of a low, immune enhancing, dose of an mTOR inhibitor.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, at least 70 but no more than 90%, at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, at least 60 but no more than 80%, at least 5 but no more than 70%, at least 10 but no more than 70%, at least 15, but no more than 70%, at least 20 but no more than 70%, at least 30 but no more than 70%, at least 40 but no more than 70%, at least 50 but no more than 70%, at least 5 but no more than 60%, at least 10 but no more than 60%, at least 15, but no more than 60%, at least 20 but no more than 60%, at least 30 but no more than 60%, at least 40 but no more than 60%, at least 5 but no more than 50%, at least 10 but no more than 50%, at least 15, but no more than 50%, at least 20 but no more than 50%, at least 30 but no more than 50%, at least 40 but no more than 50%, at least 5 but no more than 40%, at least 10 but no more than 40%, at least 15, but no more than 40%, at least 20 but no more than 40%, at least 30 but no more than 40%, at least 35 but no more than 40%, at least 5 but no more than 30%, at least 10 but no more than 30%, at least 15, but no more than 30%, at least 20 but no more than 30%, or at least 25 but no more than 30%.

The extent of mTOR inhibition can be conveyed as, or corresponds to, the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by various methods, such as measuring P70 S6 kinase activity by the Boulay assay, as described in U.S. Patent Application No. 2015/01240036, hereby incorporated by reference, or as described in U.S. Pat. No. 7,727,950, hereby incorporated by reference; measuring the level of phosphorylated S6 by western blot; or evaluating a change in the ratio of PD1 negative immune effector cells to PD1 positive immune effector cells.

As used herein, the term "mTOR inhibitor" refers to a compound or ligand, or a pharmaceutically acceptable salt thereof, which inhibits the mTOR kinase in a cell. In an embodiment, an mTOR inhibitor is an allosteric inhibitor. Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity. In an embodiment, an mTOR inhibitor is a catalytic inhibitor.

Rapamycin is a known macrolide antibiotic produced by *Streptomyces hygroscopicus* having the structure shown in Formula A.

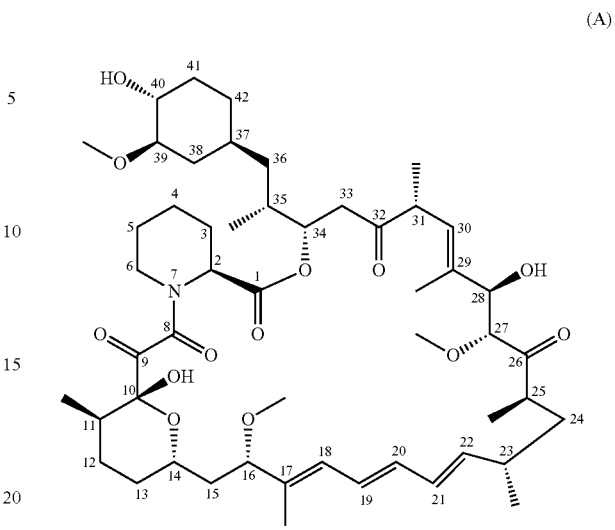

(A)

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, 0-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as, everolimus as described in U.S. Pat. No. 5,665,772 and WO94/09010 the contents of which are incorporated by reference. Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2- aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethylkapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. Pat. No. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807 the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demthoxy-16-(pent-2-ynyl)oxy-rapamycin, 16-demthoxy-16-(but-2-ynyl)oxy-rapamycin, 16-demthoxy-16-(propargyl)oxy-rapamycin, 16-demethoxy-16-(4-hydroxy-but-2-ynyl)oxy-rapamycin, 16-demthoxy-16-benzyloxy-40-O-(2-hydroxyethyl)-rapamycin, 16-demthoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibtors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form. the synthesis of BEZ235 is described in WO2006/122806; CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxyphenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl)sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTor inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Methods and Biomarkers for Evaluating CAR-Effectiveness or Sample Suitability

In another aspect, the invention features a method of evaluating or monitoring the effectiveness of a CAR-expressing cell therapy (e.g., a CD123 CAR therapy), in a subject (e.g., a subject having a cancer, e.g., a hematological cancer), or the suitability of a sample (e.g., an apheresis sample) for a CAR therapy (e.g., a CD123 CAR therapy). The method includes acquiring a value of effectiveness to the CAR therapy, or sample suitability, wherein said value is indicative of the effectiveness or suitability of the CAR-expressing cell therapy.

In embodiments, the value of effectiveness to the CAR therapy, or sample suitability, comprises a measure of one, two, three, four, five, six or more (all) of the following:

(i) the level or activity of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, in a sample (e.g., an apheresis sample or a manufactured CAR-expressing cell product sample);

(ii) the level or activity of one, two, three, or more (e.g., all) of activated $T_{EFF}$ cells, activated $T_{REG}$ cells, older T cells (e.g., older CD4 or CD8 cells), or late memory T cells, or a combination thereof, in a sample (e.g., an apheresis sample or a manufactured CAR-expressing cell product sample);

(iii) the level or activity of an immune cell exhaustion marker, e.g., one, two or more immune checkpoint inhibitors (e.g., PD-1, PD-L1, TIM-3 and/or LAG-3) in a sample (e.g., an apheresis sample or a manufactured CAR-expressing cell product sample). In one embodiment, an immune cell has an exhausted phenotype, e.g., co-expresses at least two exhaustion markers, e.g., co-expresses PD-1 and TIM-3. In other embodiments, an immune cell has an exhausted phenotype, e.g., co-expresses at least two exhaustion markers, e.g., co-expresses PD-1 and LAG-3;

(iv) the level or activity of CD27 and/or CD45RO− (e.g., CD27+ CD45RO−) immune effector cells, e.g., in a CD4+ or a CD8+ T cell population, in a sample (e.g., an apheresis sample or a manufactured CAR-expressing cell product sample);

(v) the level or activity of one, two, three, four, five, ten, twenty or more of the biomarkers chosen from CCL20, IL-17a and/or IL-6, PD-1, PD-L1, LAG-3, TIM-3, CD57, CD27, CD122, CD62L, KLRG1;

(vi) a cytokine level or activity (e.g., quality of cytokine repertoire) in a CAR-expressing cell product sample, e.g., CD123-expressing cell product sample; or (vii) a transduction efficiency of a CAR-expressing cell in a manufactured CAR-expressing cell product sample.

In some embodiments of any of the methods disclosed herein, the CAR-expressing cell therapy comprises a plurality (e.g., a population) of CAR-expressing immune effector cells, e.g., a plurality (e.g., a population) of T cells or NK cells, or a combination thereof. In one embodiment, the CAR-expressing cell therapy is a CD123 CAR therapy.

In some embodiments of any of the methods disclosed herein, the measure of one or more of (i)-(vii) is obtained from an apheresis sample acquired from the subject. The apheresis sample can be evaluated prior to infusion or re-infusion.

In some embodiments of any of the methods disclosed herein, the measure of one or more of (i)-(vii) is obtained from a manufactured CAR-expressing cell product sample, e.g., CD123 CAR-expressing cell product sample. The manufactured CAR-expressing cell product can be evaluated prior to infusion or re-infusion.

In some embodiments of any of the methods disclosed herein, the subject is evaluated prior to receiving, during, or after receiving, the CAR-expressing cell therapy.

In some embodiments of any of the methods disclosed herein, the measure of one or more of (i)-(vii) evaluates a profile for one or more of gene expression, flow cytometry or protein expression.

In some embodiments of any of the methods disclosed herein, the method further comprises identifying the subject as a responder, a non-responder, a relapser or a non-relapser, based on a measure of one or more of (i)-(vii).

In some embodiments of any of the methods disclosed herein, a responder (e.g., a complete responder) has, or is identified as having, a greater level or activity of one, two, or more (all) of GZMK, PPF1BP2, or naïve T cells as compared to a non-responder.

In some embodiments of any of the methods disclosed herein, a non-responder has, or is identified as having, a greater level or activity of one, two, three, four, five, six, seven, or more (e.g., all) of IL22, IL-2RA, IL-21, IRF8, IL8, CCL17, CCL22, effector T cells, or regulatory T cells, as compared to a responder.

In an embodiment, a relapser is a patient having, or who is identified as having, an increased level of expression of one or more of (e.g., 2, 3, 4, or all of) the following genes, compared to non relapsers: MIR199A1, MIR1203, uc021ovp, ITM2C, and HLA-DQB1 and/or a decreased levels of expression of one or more of (e.g., 2, 3, 4, 5, 6, 7, 8, 9, 10, 11, or all of) the following genes, compared to non relapsers: PPIAL4D, TTTY10, TXLNG2P, MIR4650-1, KDM5D, USP9Y, PRKY, RPS4Y2, RPS4Y1, NCRNA00185, SULT1E1, and EIF1AY.

In some embodiments of any of the methods disclosed herein, a complete responder has, or is identified as having, a greater, e.g., a statistically significant greater, percentage of CD8+ T cells compared to a reference value, e.g., a non-responder percentage of CD8+ T cells.

In some embodiments of any of the methods disclosed herein, a complete responder has, or is identified as having, a greater percentage of CD27+ CD45RO− immune effector cells, e.g., in the CD8+ population, compared to a reference value, e.g., a non-responder number of CD27+ CD45RO− immune effector cells.

In some embodiments of any of the methods disclosed herein, a complete responder or a partial responder has, or is identified as having, a greater, e.g., a statistically significant greater, percentage of CD4+ T cells compared to a reference value, e.g., a non-responder percentage of CD4+ T cells.

In some embodiments of any of the methods disclosed herein, a complete responder has, or is identified as having, a greater percentage of one, two, three, or more (e.g., all) of resting $T_{EFF}$ cells, resting $T_{REG}$ cells, younger T cells (e.g., younger CD4 or CD8 cells, or gamma/delta T cells), or early memory T cells, or a combination thereof, compared to a reference value, e.g., a non-responder number of resting $T_{EFF}$ cells, resting $T_{REG}$ cells, younger T cells (e.g., younger CD4 or CD8 cells), or early memory T cells.

In some embodiments of any of the methods disclosed herein, a non-responder has, or is identified as having, a greater percentage of one, two, three, or more (e.g., all) of activated $T_{EFF}$ cells, activated $T_{REG}$ cells, older T cells (e.g., older CD4 or CD8 cells), or late memory T cells, or a combination thereof, compared to a reference value, e.g., a responder number of activated $T_{EFF}$ cells, activated $T_{REG}$ cells, older T cells (e.g., older CD4 or CD8 cells), or late memory T cells.

In some embodiments of any of the methods disclosed herein, a non-responder has, or is identified as having, a greater percentage of an immune cell exhaustion marker, e.g., one, two or more immune checkpoint inhibitors (e.g., PD-1, PD-L1, TIM-3 and/or LAG-3). In one embodiment, a non-responder has, or is identified as having, a greater percentage of PD-1, PD-L1, or LAG-3 expressing immune effector cells (e.g., CD4+ T cells and/or CD8+ T cells) (e.g., CAR-expressing CD4+ cells and/or CD8+ T cells) compared to the percentage of PD-1 or LAG-3 expressing immune effector cells from a responder.

In one embodiment, a non-responder has, or is identified as having, a greater percentage of immune cells having an exhausted phenotype, e.g., immune cells that co-express at least two exhaustion markers, e.g., co-expresses PD-1, PD-L1 and/or TIM-3. In other embodiments, a non-responder has, or is identified as having, a greater percentage of immune cells having an exhausted phenotype, e.g., immune cells that co-express at least two exhaustion markers, e.g., co-expresses PD-1 and LAG-3.

In some embodiments of any of the methods disclosed herein, a non-responder has, or is identified as having, a greater percentage of PD-1/PD-L1+/LAG-3+ cells in the CAR-expressing cell population (e.g., a CD123 CAR+ cell population) compared to a responder (e.g., a complete responder) to the CAR-expressing cell therapy.

In some embodiments of any of the methods disclosed herein, a partial responder has, or is identified as having, a higher percentages of PD-1/PD-L1+/LAG-3+ cells, than a responder, in the CAR-expressing cell population (e.g., a CD123 CAR+ cell population).

In some embodiments of any of the methods disclosed herein, a non-responder has, or is identified as having, an exhausted phenotype of PD1/PD-L1+CAR+ and co-expression of LAG3 in the CAR-expressing cell population (e.g., a CD123 CAR+ cell population).

In some embodiments of any of the methods disclosed herein, a non-responder has, or is identified as having, a greater percentage of PD-1/PD-L1+/TIM-3+ cells in the CAR-expressing cell population (e.g., a CD123 CAR+ cell population) compared to the responder (e.g., a complete responder).

In some embodiments of any of the methods disclosed herein, a partial responders has, or is identified as having, a higher percentage of PD-1/PD-L1+/TIM-3+ cells, than responders, in the CAR-expressing cell population (e.g., a CD123 CAR+ cell population).

In some embodiments of any of the methods disclosed herein, the presence of CD8+CD27+ CD45RO− T cells in an apheresis sample is a positive predictor of the subject response to a CAR-expressing cell therapy (e.g., a CD123 CAR therapy).

In some embodiments of any of the methods disclosed herein, a high percentage of PD1+CAR+ and LAG3+ or TIM3+ T cells in an apheresis sample is a poor prognostic predictor of the subject response to a CAR-expressing cell therapy (e.g., a CD123 CAR therapy).

In some embodiments of any of the methods disclosed herein, the responder (e.g., the complete or partial responder) has one, two, three or more (or all) of the following profile:

(i) has a greater number of CD27+ immune effector cells compared to a reference value, e.g., a non-responder number of CD27+ immune effector cells;

(ii) (i) has a greater number of CD8+ T cells compared to a reference value, e.g., a non-responder number of CD8+ T cells;

(iii) has a lower number of immune cells expressing one or more checkpoint inhibitors, e.g., a checkpoint inhibitor chosen from PD-1, PD-L1, LAG-3, TIM-3, or KLRG-1, or a combination, compared to a reference value, e.g., a non-responder number of cells expressing one or more checkpoint inhibitors; or (iv) has a greater number of one, two, three, four or more (all) of resting $T_{EFF}$ cells, resting $T_{REG}$ cells, naïve CD4 cells, unstimulated memory cells or early memory T cells, or a combination thereof, compared to a reference value, e.g., a non-responder number of resting $T_{EFF}$ cells, resting $T_{REG}$ cells, naïve CD4 cells, unstimulated memory cells or early memory T cells.

In some embodiments of any of the methods disclosed herein, the cytokine level or activity of (vi) is chosen from one, two, three, four, five, six, seven, eight, or more (or all) of cytokine CCL20/MIP3a, IL17A, IL6, GM-CSF, IFNγ, IL10, IL13, IL2, IL21, IL4, IL5, IL9 or TNFα, or a combination thereof. The cytokine can be chosen from one, two, three, four or more (all) of IL-17a, CCL20, IL2, IL6, or TNFa. In one embodiment, an increased level or activity of a cytokine is chosen from one or both of IL-17a and CCL20, is indicative of increased responsiveness or decreased relapse.

In some embodiments of any of the methods disclosed herein, a transduction efficiency of 15% or higher in (vii) is indicative of increased responsiveness or decreased relapse.

In some embodiments of any of the methods disclosed herein, a transduction efficiency of less than 15% in (vii) is indicative of decreased responsiveness or increased relapse.

In embodiments, the responder, a non-responder, a relapser or a non-relapser identified by the methods herein can be further evaluated according to clinical criteria. For example, a complete responder has, or is identified as, a subject having a disease, e.g., a cancer, who exhibits a complete response, e.g., a complete remission, to a treatment. A complete response may be identified, e.g., using the NCCN Guidelines®, or Cheson et al, J Clin Oncol 17:1244 (1999) and Cheson et al., "Revised Response Criteria for Malignant Lymphoma", J Clin Oncol 25:579-586 (2007) (both of which are incorporated by reference herein in their entireties), as described herein. A partial responder has, or is identified as, a subject having a disease, e.g., a cancer, who exhibits a partial response, e.g., a partial remission, to a treatment. A partial response may be identified, e.g., using the NCCN Guidelines®, or Cheson criteria as described herein. A non-responder has, or is identified as, a subject having a disease, e.g., a cancer, who does not exhibit a response to a treatment, e.g., the patient has stable disease or progressive disease. A non-responder may be identified, e.g., using the NCCN Guidelines®, or Cheson criteria as described herein.

Alternatively, or in combination with the methods disclosed herein, responsive to said value, performing one, two, three, four or more of:

administering e.g., to a responder or a non-relapser, a CAR-expressing cell therapy;

administered an altered dosing of a CAR-expressing cell therapy;

altering the schedule or time course of a CAR-expressing cell therapy;

administering, e.g., to a non-responder or a partial responder, an additional agent in combination with a CAR-expressing cell therapy, e.g., a checkpoint inhibitor, e.g., a checkpoint inhibitor described herein;

administering to a non-responder or partial responder a therapy that increases the number of younger T cells in the subject prior to treatment with a CAR-expressing cell therapy;

modifying a manufacturing process of a CAR-expressing cell therapy, e.g., enriching for younger T cells prior to introducing a nucleic acid encoding a CAR, or increasing the transduction efficiency, e.g., for a subject identified as a non-responder or a partial responder;

administering an alternative therapy, e.g., for a non-responder or partial responder or relapser; or if the subject is, or is identified as, a non-responder or a relapser, decreasing the $T_{REG}$ cell population and/or $T_{REG}$ gene signature, e.g., by one or more of CD25 depletion, administration of cyclophosphamide, anti-GITR antibody, or a combination thereof.

In certain embodiments, the subject is pre-treated with an anti-GITR antibody. In certain embodiment, the subject is treated with an anti-GITR antibody prior to infusion or re-infusion.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic.

Examples of suitable biopolymers include, but are not limited to, agar, agarose, alginate, alginate/calcium phosphate cement (CPC), beta-galactosidase ((3-GAL), (1,2,3,4, 6-pentaacetyl a-D-galactose), cellulose, chitin, chitosan, collagen, elastin, gelatin, hyaluronic acid collagen, hydroxyapatite, poly(3-hydroxybutyrate-co-3-hydroxyhexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., Nature Biotechnology, 2015, 33:97-101; and WO2014/110591.

Pharmaceutical Compositions and Treatments

Pharmaceutical compositions of the present invention may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia,* and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages.

In some embodiments, a dose of CAR cells (e.g., CD123 CAR cells) comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD123 CAR cells) comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD123 CAR cells) comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD123 CAR cells) comprises about $1.1\times10^6$-$1.8\times10^7$ cells/kg. In some embodiments, a dose of CAR cells (e.g., CD123 CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD123 CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD123 CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells.

The cells can be administered by using infusion techniques that are commonly known in immunotherapy (see, e.g., Rosenberg et al., New Eng. J. of Med. 319:1676, 1988).

In certain aspects, it may be desired to administer activated T cells to a subject and then subsequently redraw blood (or have an apheresis performed), activate T cells therefrom according to the present invention, and reinfuse the patient with these activated and expanded T cells. This process can be carried out multiple times every few weeks. In certain aspects, T cells can be activated from blood draws of from 10 cc to 400 cc. In certain aspects, T cells are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the CAR-expressing cell (e.g., T cell or NK cell) compositions of the present invention are administered to a patient by intradermal or subcutaneous injection. In one aspect, the CAR-expressing cell (e.g., T cell or NK cell) compositions of the present invention are administered by i.v. injection. The compositions of the CAR-expressing cell (e.g., T cell or NK cell) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., immune effector cells (e.g., T cells or NK cells). These immune effector cell (e.g., T cell or NK cell) isolates may be expanded by methods known in the art and treated such that one or more CAR constructs of the invention may be introduced, thereby creating a CAR-expressing cell (e.g., CAR T cell or CAR-expressing NK cell) of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cell (e.g., CAR T cell or CAR-expressing NK cell) of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one embodiment, the CAR is introduced into immune effector cells (e.g., T cells or NK cells), e.g., using in vitro transcription, and the subject (e.g., human) receives an initial administration of a CAR-expressing cell (e.g., CAR T cell or CAR-expressing NK cell) of the invention, and one or more subsequent administrations of the CAR-expressing cell (e.g., CAR T cell or CAR-expressing NK cell) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR-expressing cell (e.g., CAR T cell or CAR-expressing NK cell) of the invention are administered to the subject (e.g., human) per week, e.g., 2, 3, or 4 administrations of the CAR-expressing cell (e.g., CAR T cell or CAR-expressing NK cell) of the invention are administered per week. In one embodiment, the subject (e.g., human subject) receives more than one administration of the CAR-expressing cell (e.g., CAR T cell or CAR-expressing NK cell) per week (e.g., 2, 3 or 4 administrations per week) (also referred to herein as a cycle), followed by a week of no CAR-expressing cell (e.g., CAR T cell or CAR-expressing NK cell) administrations, and then one or more additional administration of the CAR-expressing cell (e.g., CAR T cell or CAR-expressing NK cell) (e.g., more than one administration of the CAR-expressing cell (e.g., CAR T cell or CAR-expressing NK cell) per week) is administered to the subject. In another embodiment, the subject (e.g., human subject) receives more than one cycle of CAR-expressing cell (e.g., CAR T cell or CAR-expressing NK cell), and the time between each cycle is less than 10, 9, 8, 7, 6, 5, 4, or 3 days. In one embodiment, the CAR-expressing cell (e.g., CAR T cell or CAR-expressing NK cell) are administered every other day for 3 administrations per week. In one embodiment, the CAR-expressing cell (e.g., CAR T cell or CAR-expressing NK cell) of the invention are administered for at least two, three, four, five, six, seven, eight or more weeks.

In one aspect, CD123 CAR-expressing cell (e.g., CAR T cell or CAR-expressing NK cell) are generated using lentiviral viral vectors, such as lentivirus. CAR-expressing cell (e.g., CAR T cell or CAR-expressing NK cell) generated that way will have stable CAR expression.

In one aspect, CAR-expressing cells, e.g., CARTs or CAR-expressing NK cells, are generated using a viral vector such as a gammaretroviral vector, e.g., a gammaretroviral vector described herein. CAR-expressing cells, e.g., CARTs or CAR-expressing NK cells, generated using these vectors can have stable CAR expression.

In one aspect, the CAR-expressing cell (e.g., CAR T cell or CAR-expressing NK cell) transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell (e.g., T cell or NK cell) by electroporation.

A potential issue that can arise in patients being treated using transiently expressing CAR cell (e.g., CAR T cell or CAR-expressing NK cell) (particularly with murine scFv bearing CARs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CAR-expressing cell (e.g., CAR T cell or CAR-expressing NK cell) infusion breaks should not last more than ten to fourteen days.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples specifically point out various aspects of the present invention, and are not to be construed as limiting in any way the remainder of the disclosure.

Example 1

Human CAR Constructs

Fully human anti-CD123 single chain variable fragments were isolated. Anti-CD123 ScFvs were cloned into lentiviral CAR expression vectors with the CD3zeta chain and the 4-1BB costimulatory molecule. CAR-containing plasmids (Table 1 provided in the Detailed Description) were amplified by bacterial transformation in STBL3 cells, followed by Maxiprep using endotoxin-free Qiagen Plasmid Maki kit. Lentiviral supernatant was produced in 293T cells using standard techniques.

The order in which the VL and VH domains appear in the scFv was varied (i.e., VL-VH, or VH-VL orientation), and where either three or four copies of the "G4S" (SEQ ID NO:25) subunit, in which each subunit comprises the sequence GGGGS (SEQ ID NO:25) (e.g., (G4S)$_3$ (SEQ ID NO:28) or (G4S)$_4$(SEQ ID NO:27)), connect the variable domains to create the entirety of the scFv domain, as shown in Table 2 (provided in the Detailed Description).

Sequences of CAR constructs and their domain sequences are listed in the Detailed Description. Analysis of the human CAR constructs was conducted as described in, e.g. Examples 2, 3, and 6.

Example 2

Analysis and In Vitro Activity of Human scFv Bearing CARTs

Human anti-CD123 CAR constructs were evaluated for activity using a Jurkat cell line containing the luciferase reporter driven by the NFAT promoter (termed JNL cells). CD123 CAR activity was measured for four human CAR constructs described herein (CD123 CAR1-4) and murine CD123 CAR constructs 1172 and 1176. The amino acid sequence for the 1172 and 1176 constructs are provided below, and are further described and characterized in PCT/US2014/017328.

```
1172 construct: CD123 4-1BBCD3z-CAR
(amino acid sequence)
                                (SEQ ID NO: 707)
MALPVTALLLPLALLLHAARPGSDIVLTQSPASLAVSLGQRATISCRASE

SVDNYGNTFMHWYQQKPGQPPKLLIYRASNLESGIPARFSGSGSRTDFTL

TINPVEADDVATYYCQQSNEDPPTFGAGTKLELKGGGGSGGGGSGGGSQ

IQLVQSGPELKKPGETVKISCKASGYIFTNYGMNWVKQAPGKSFKWMGWI

NTYTGESTYSADFKGRFAFSLETSASTAYLHINDLKNEDTATYFCARSGG

YDPMDYWGQGTSVTVSSASSGTTTPAPRPPTPAPTIASQPLSLRPEACRP

AAGGAVHTRGLDFACDIYIWAPLAGTCGVLLLSLVITLYCKRGRKKLLYI

FKQPFMRPVQTTQEEDGCSCRFPEEEEGGCELRVKFSRSADAPAYKQGQN

QLYNELNLGRREEYDVLDKRRGRDPEMGGKPRRKNPQEGLYNELQKDKMA

EAYSEIGMKGERRRGKGHDGLYQGLSTATKDTYDALHMQALPPR
```

```
1176 construct: CD123 4-1BBCD3z-CAR (26292)
(amino acid sequence)
                                (SEQ ID NO: 708)
MALPVTALLLPLALLLHAARPGSDVQITQSPSYLAASPGETITINCRASK

SISKDLAWYQEKPGKTNKLLIYSGSTLQSGIPSRFSGSGSGTDFTLTISS

LEPEDFAMYYCQQHNKYPYTFGGGTKLEIKGGGGSGGGGSSGGGSQVQLQ

QPGAELVRPGASVKLSCKASGYTFTSYWMNWVKQRPDQGLEWIGRIDPYD

SETHYNQKFKDKAILTVDKSSSTAYMQLSSLTSEDSAVYYCARGNWDDYW

GQGTTLTVSSASSGTTTPAPRPPTPAPTIASQPLSLRPEACRPAAGGAVH

TRGLDFACDIYIWAPLAGTCGVLLLSLVITLYCKRGRKKLLYIFKQPFMR

PVQTTQEEDGCSCRFPEEEEGGCELRVKFSRSADAPAYKQGQNQLYNELN

LGRREEYDVLDKRRGRDPEMGGKPRRKNPQEGLYNELQKDKMAEAYSEIG

MKGERRRGKGHDGLYQGLSTATKDTYDALHMQALPPR
```

Figure 2A:
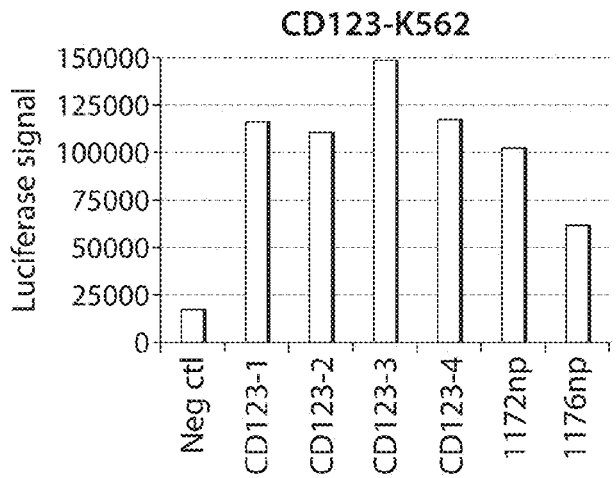
FIGS. 2A, 2B, and 2C show graphical representations of CD123 CAR activity in JNL cells. Anti-CD123 CAR constructs were evaluated for activity using a Jurkat cell line containing the luciferase reporter driven by the NFAT promoter (termed JNL cells). CAR activity is measured as activation of this NFAT-driven reporter.
Figure 2B:
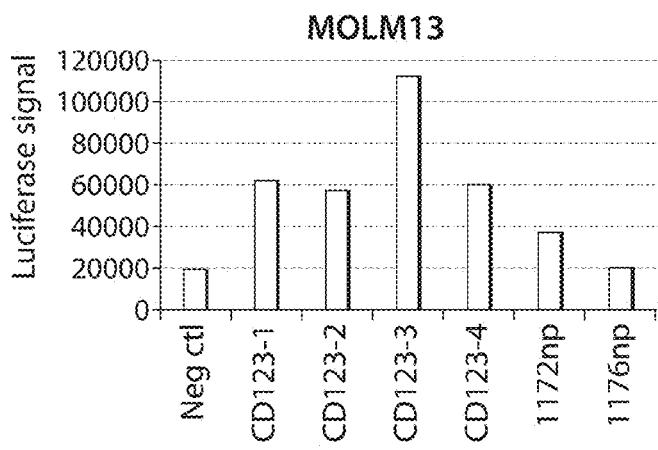
Figure 2C:
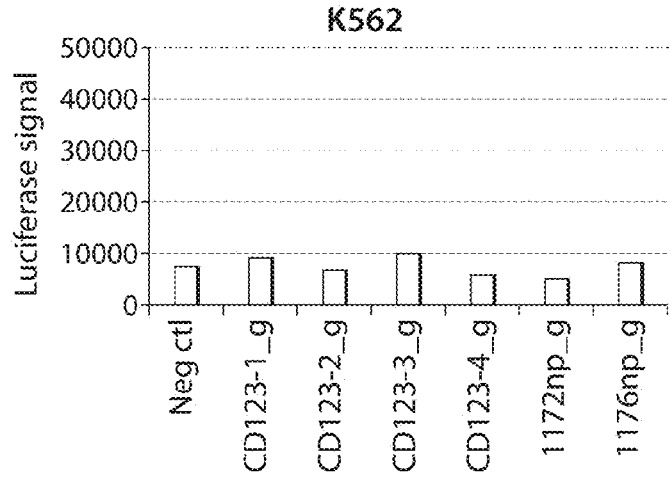

CAR activity was measured as activation of this NFAT-driven reporter. Lentiviral supernatants containing the CART constructs were added to JNL cells for transduction. 4-6 days after transduction, JNL cells were either evaluated for CAR expression by FACS as described below or mixed with target-positive (MOLM3, K562 cells engineered to express CD123 (CD123-K562)) or target-negative (K562) cell lines at an effector (JNL) to target cell line (E:T) ratio of 3:1 to trigger activation (FIG. 1). After 20 hours of co-incubation, luciferase signal was measured using the Bright-Glo™ Luciferase Assay on the EnVision instrument as shown in FIGS. 2A-2C.

Optimal anti-CD123 CAR constructs were selected based on the quantity and quality of the effector T cell responses of CD123 CAR transduced T cells ("CART-CD123" or "CART-CD123 T cells") in response to CD123 expressing ("CD123+") targets. Effector T cell responses include, but are not limited to, cellular expansion, proliferation, doubling, cytokine production and target cell killing or cytolytic activity (degranulation).

Generation of CART-CD123

The human scFv encoding lentiviral transfer vectors were used to produce the genomic material packaged into the VSVg pseudotyped lentiviral particles. Lentiviral transfer vector DNA was mixed with the three packaging components of VSVg, gag/pol and rev in combination with lipofectamine reagent to transfect them together in to Lenti-X 293T cells (Clontech).

After 30 hours, the media was collected, filtered and stored at −80C. The therapeutic CART-CD123 were generated by starting with the blood from a normal apheresed donor whose naïve T cells were obtained by negative selection for T cells, CD4+ and CD8+ lymphocytes. These cells were activated by CD3×28 beads (Dynabeads® Human T-Expander CD3/CD28, Invitrogen) at a ratio of 1:3 in RPMI 1640, 10% heat-inactivated fetal calf serum (FCS), 2 mM L-glutamine, 1× Penicillin/Streptomycin, 100 μM non-essential amino acids, 1 mM NaPyruvate, 10 mM Hepes, and 55 μM 2-mercaptoethanol at 37° C., 5% $CO_2$ T cells were cultured at 1×10$^6$ T cells in 0.5 mL medium per well of a 24-well plate. After 24 hours, the T cells was blasting and 0.5 mL of viral supernatant was added. The T cells then began to divide in a logarithmic growth pattern, which was monitored by measuring the cell counts per mL, and T cells were diluted in fresh medium every two days. As the T cells began to rest down after approximately 10 days, the logarithmic growth waned. The combination of slowing growth rate and T cell size approaching ~300 fl determined the state for T cells to be cryopreserved for later analysis.

Before cryopreserving, percentage of cells transduced (expressing the anti-CD123 CAR on the cell surface) and their relative fluorescence intensity of expression were determined by flow cytometric analysis on a BD LSR-Fortessa or BD-FACSCanto using Protein L as a detection reagent. Gating histogram plots of relative fluorescent intensity from that FACS for signal above unstained cells demonstrated the percentage of transduced T cells. Transduction resulted in a range of CART positive cells from 12-42% as shown in FIGS. 2A-2C.

Evaluating Cytolytic Activity of CART-CD123 Redirected T Cells.

To evaluate the functional abilities of CART-CD123 T cells to kill target expressing cells, the cells were thawed and allowed to recover overnight.

Figure 3:
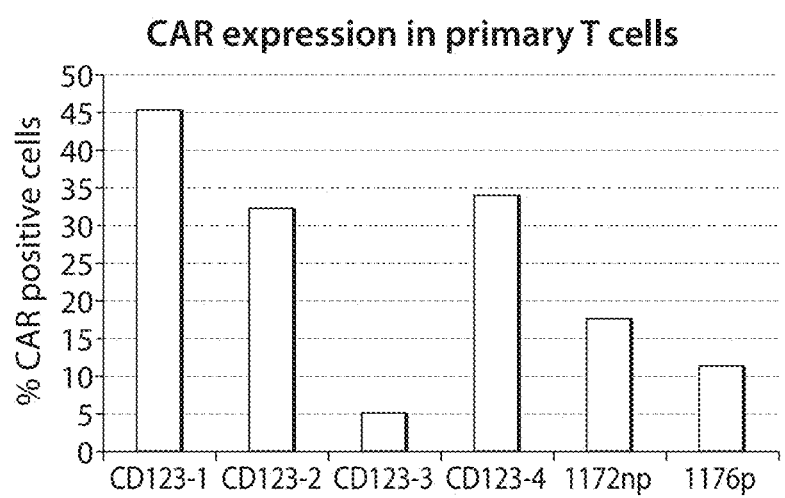
FIG. 3 shows a graphical representation of CD123 CAR expression in primary T-cells. Percentage of cells transduced (expressing the anti-CD123 CAR on the cell surface) and their relative fluorescence intensity of expression were determined by flow cytometric analysis on a BD LSR-Fortessa or BD-FACSCanto using Protein L as a detection reagent. Gating histogram plots of relative fluorescent intensity from that FACS for signal above unstained cells shows the percentage of transduced T cells. Transduction resulted in a range of CAR positive cells from 12-42%.
Figure 4:
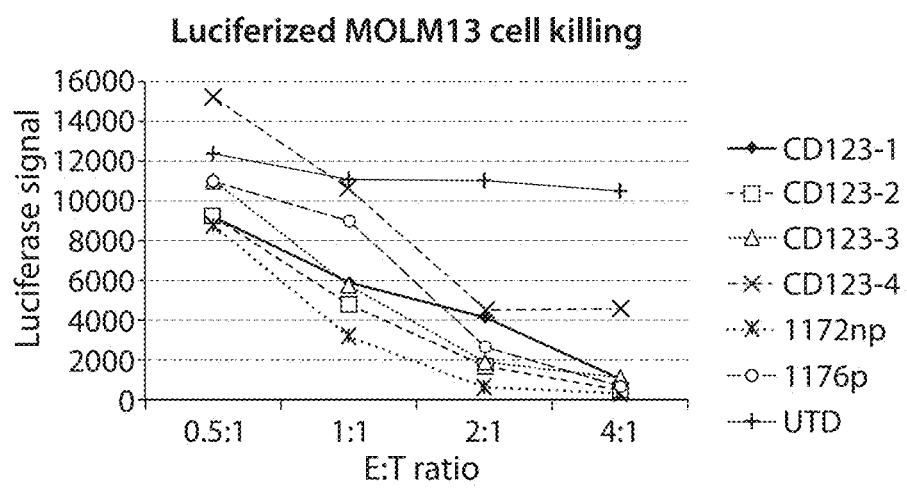
FIG. 4 shows a graphical representation of CD123-CART-mediated cell killing. T cell killing was directed towards CD123-expressing MOLM13 acute myelogenous leukemia cells stably expressing luciferase. Untransduced T cells were used to determine non-specific background killing levels. The cytolytic activities of CART-CD123 were measured over a range of effector:target cell ratios of 4:1 and 2-fold downward dilutions of T cells where effectors were defined as T cells expressing the anti-CD123 chimeric receptor. Assays were initiated by mixing an appropriate number of T cells with a constant number of targets cells. After 20 hours luciferase signal was measured using the Bright-Glo™ Luciferase Assay on the EnVision instrument.

T cell killing was directed towards CD123-expressing MOLM13 acute myelogenous leukemia cell lines stably expressing luciferase. Untransduced T cells were used to determine non-specific background killing levels. The cytolytic activities of CART-CD123 were measured as a titration of effector:target cell ratios of 4:1 and 2-fold downward dilutions of T cells where effectors were defined as T cells expressing the anti-CD123 chimeric receptor. Assays were initiated by mixing an appropriate number of T cells with a constant number of targets cells. After 20 hours luciferase signal was measured using the Bright-Glo™ Luciferase Assay on the EnVision instrument. As the proportion of CD123-CART-expressing cells to untransfduced T cells was increased, killing of CD123 cells was similarly increased. The data presented herein suggest that those cells expressing CD123 are destroyed only by CD123-CART-expressing cells and not by untransduced T cells. FIG. 3.

Cytokine Production

Figure 24A:
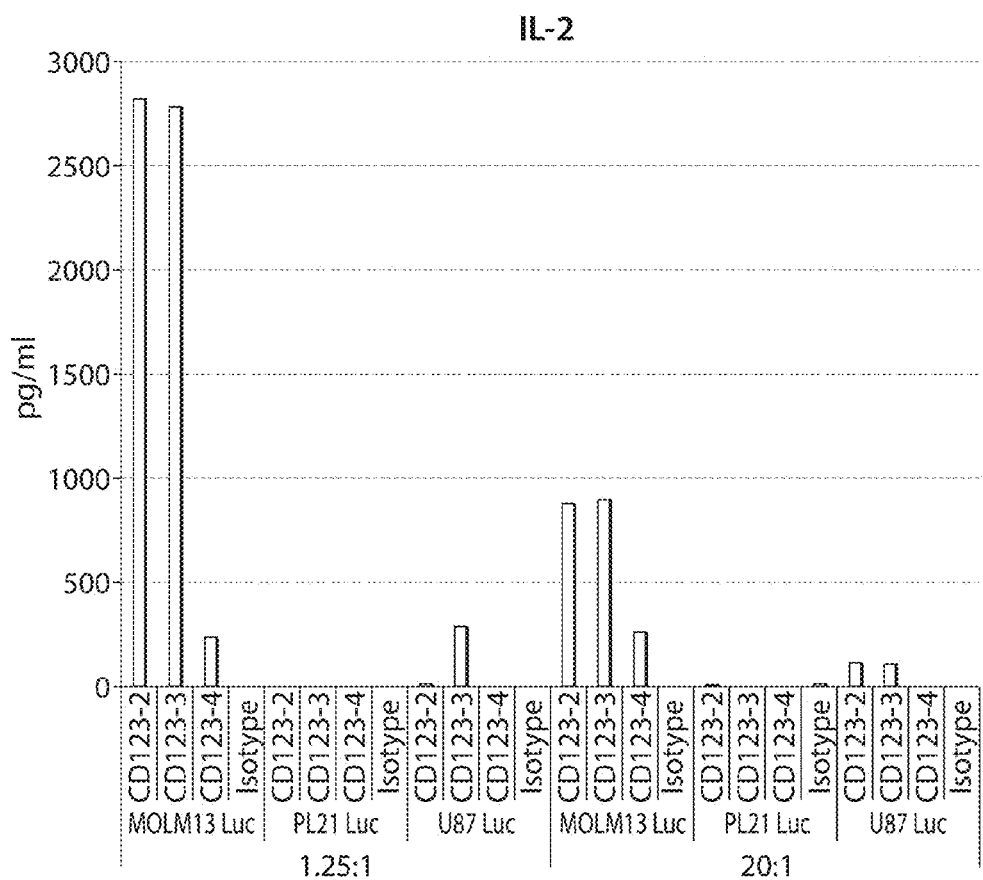
FIGS. 24A, 24B, and 24C are bar graphs showing the cytokine production from T cells expressing CAR123 constructs (CD123-2, CD123-3, and CD123-4) when cultured with target cells MOLM13, PL21, and U87 at the indicated ratios.
Figure 24B:
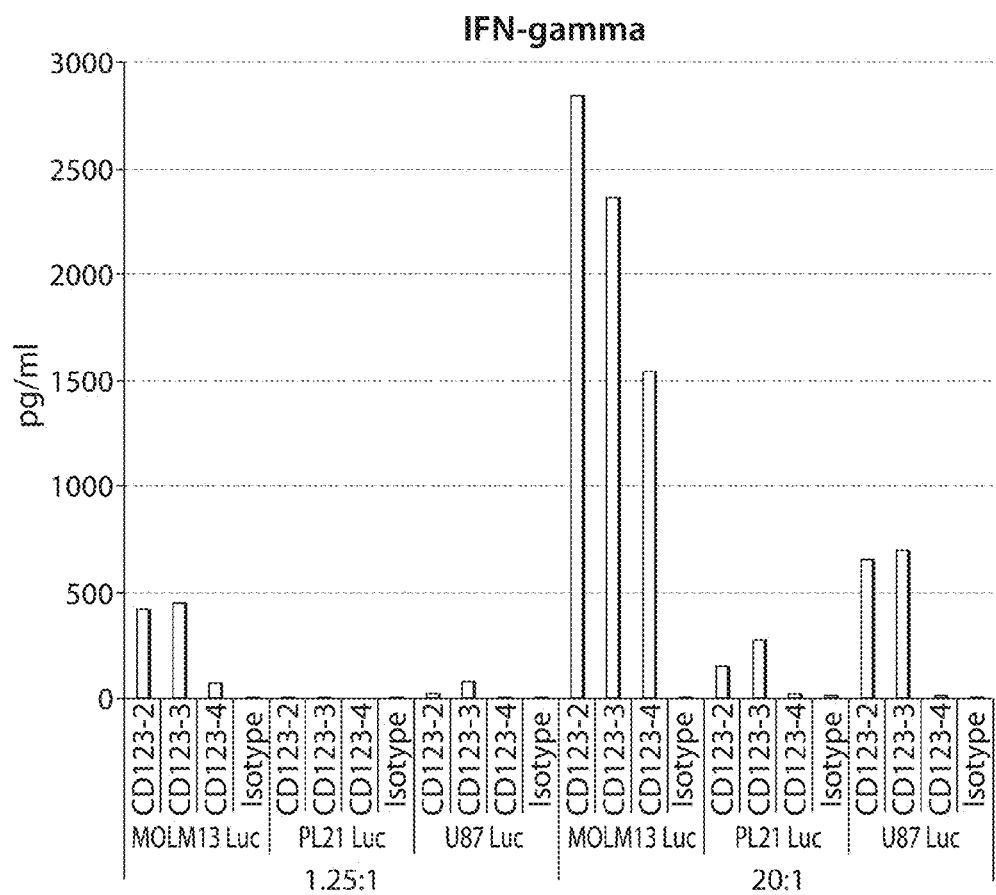
Figure 24C:
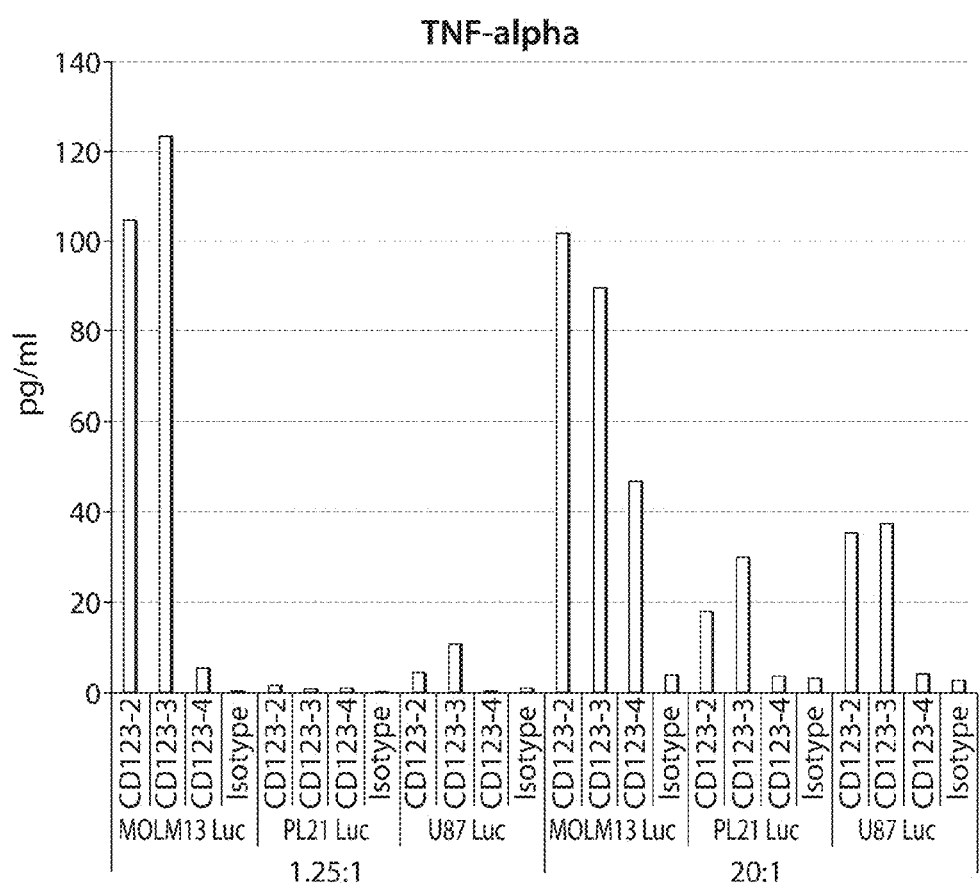

For measuring cytokine production of CD123 CART cells, cells expressing CD123-2, CD123-3, or CD123-4, were thawed and allowed to recover overnight. T cells expressing an isotype control (referred to as "isotype") were used as a non-specific control for background T cell effects. The T cells were directed towards MOLM13, PL21, or U87 cells (referred to as the target cells). The assay tested an effector:target ratio of 1.25:1 or 20:1 as noted where effectors were defined as T cells expressing the CD123 CAR. The assay was run 24 hours after mixing of the cells, when the media is removed for analysis of cytokines IL-2 (FIG. 24A), IFN-gamma (FIG. 24B), and TNF-alpha (FIG. 24C) using the CBA-Flex kit for human cytokine detection. When CD123 CAR-expressing T cells were cultured with cancer cells expressing CD123, all CD123-CARTs produced cytokines in response to target-expressing cells.

Example 3

CART123 in AML

T Cell Transduction

Human anti-human CD123 clones NVS 2 (expressing CAR123-2), NVS 3 (expressing CAR123-3), NVS 4 (expressing CAR123-4) were selected for further study. These clones were all cross-reactive against cynomolgus CD123. Their activity was compared against mouse clones 1172 and 1176, comprising the VH and VL domains in a light-to-heavy orientation with a CD8 hinge domain, CD8 transmembrane domain, and 41BB-costimulatory domain. 1176 is also cross-reactive against cynomolgus CD123. 1172 is not.

Plasmids were transformed into competent cells, grown in 500 cc broth, isolated by maxiprep, and transduced using standard methods into 293T cells. Lentiviral supernatant was collected at 24 and 48 hours, concentrated using ultracentrifugation, and frozen.

The lentivirus was titered on SupT1 cells and the appropriate amount of virus was determined for a transduction of primary T cells at a MOI of 3. Primary normal donor CD4+CD8 cells were stimulated using anti-CD3/CD28 beads (Dynal, Invitrogen) and interleukin-2 100 U/ml for 6 days, followed by debeading and were and frozen once. The T cell cellular volume decreased to <300 fL (after approx 10-12 days).

Figure 5A:
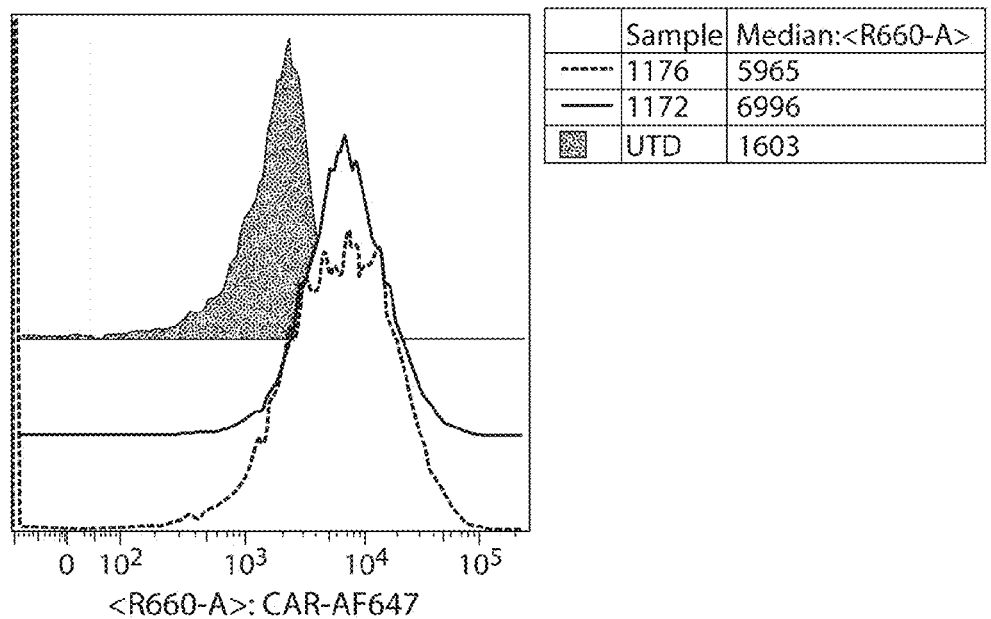
FIGS. 5A and 5B show transduction efficiency of T cells with CD123-CARs.
Figure 5B:
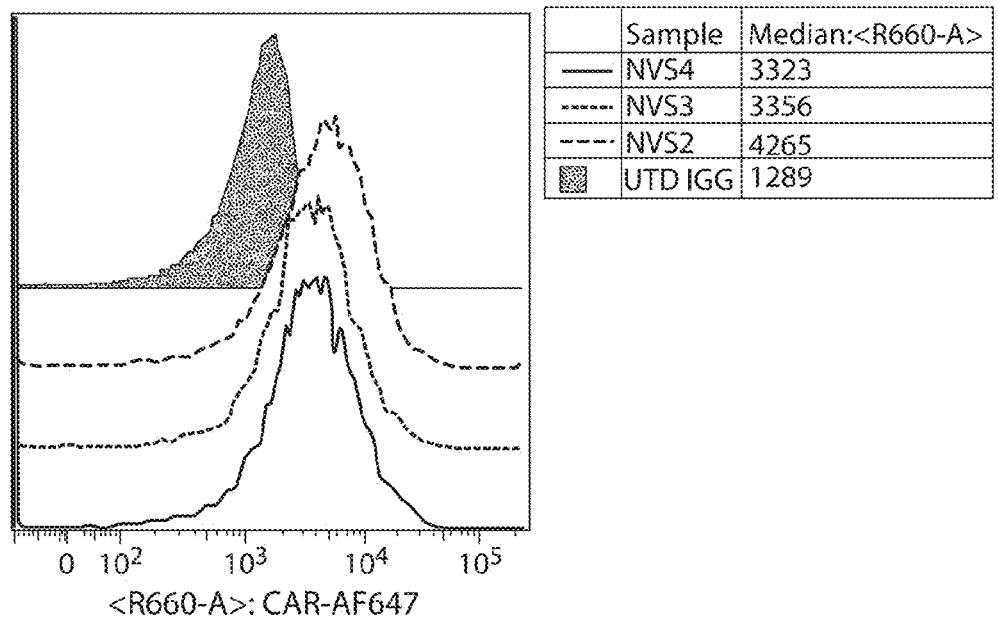
Figure 6:
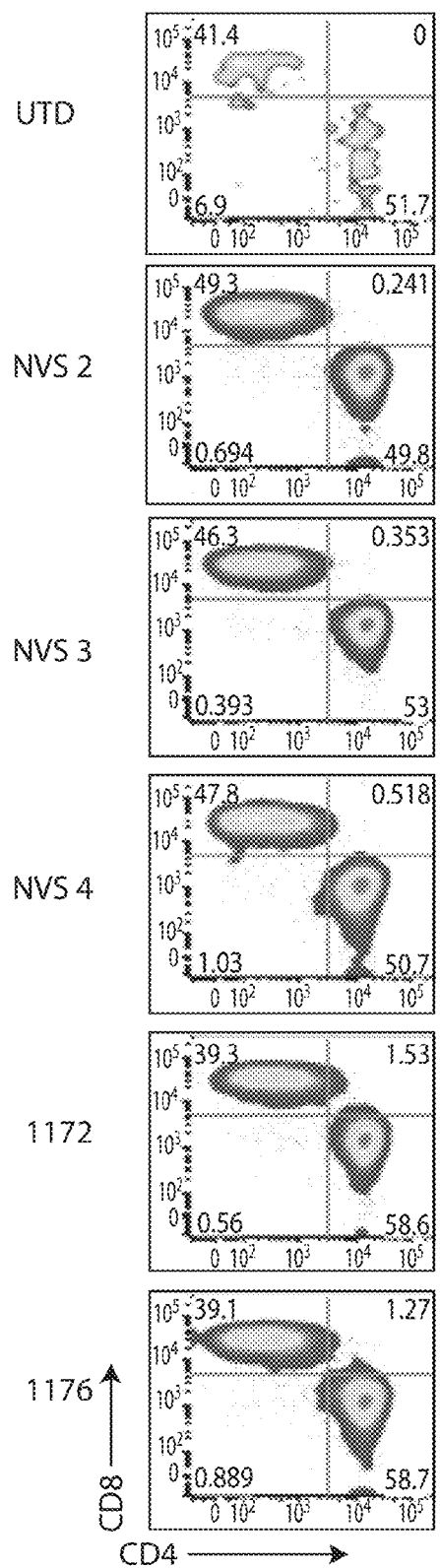
FIG. 6 shows flow cytometry of CD123 CARs 2-4 and 1172 and 1176 to determine the CD4:CD8 ratio.

T cell transduction efficiency was virtually 100% for all clones (FIGS. 5A and 5B). CD4:CD8 ratios were approximately 1:1 in the NVS clones, and 3:2 in the 1172 and 1176 clones (FIG. 6).

Degranulation

To assess degranulation, CART cells (NVS 2-4, 1172 and 1176 clones) were thawed, rested overnight at a concentration of $2e^6$ cells/ml in T cell media. Cells were then counted and resuspended at $1e^6$ cells/ml the following day. Tumor target cells (TCM, PMA/iono, MOLM14 or JURKAT) were resuspended at $5e^6$ cells/ml. Cells were plated at a ratio of $1e^5$ T cell: $5e^5$ tumor cell in 48 well plates and incubated for 2 hours in the presence of anti-CD107a PECy7, anti-CD49d purified, and anti-CD28 purified antibodies. Cells were then harvested, stained with anti-CD3 APC and acquired using BD LSR Fortessa (FIG. 7).

Figures 1, 7:
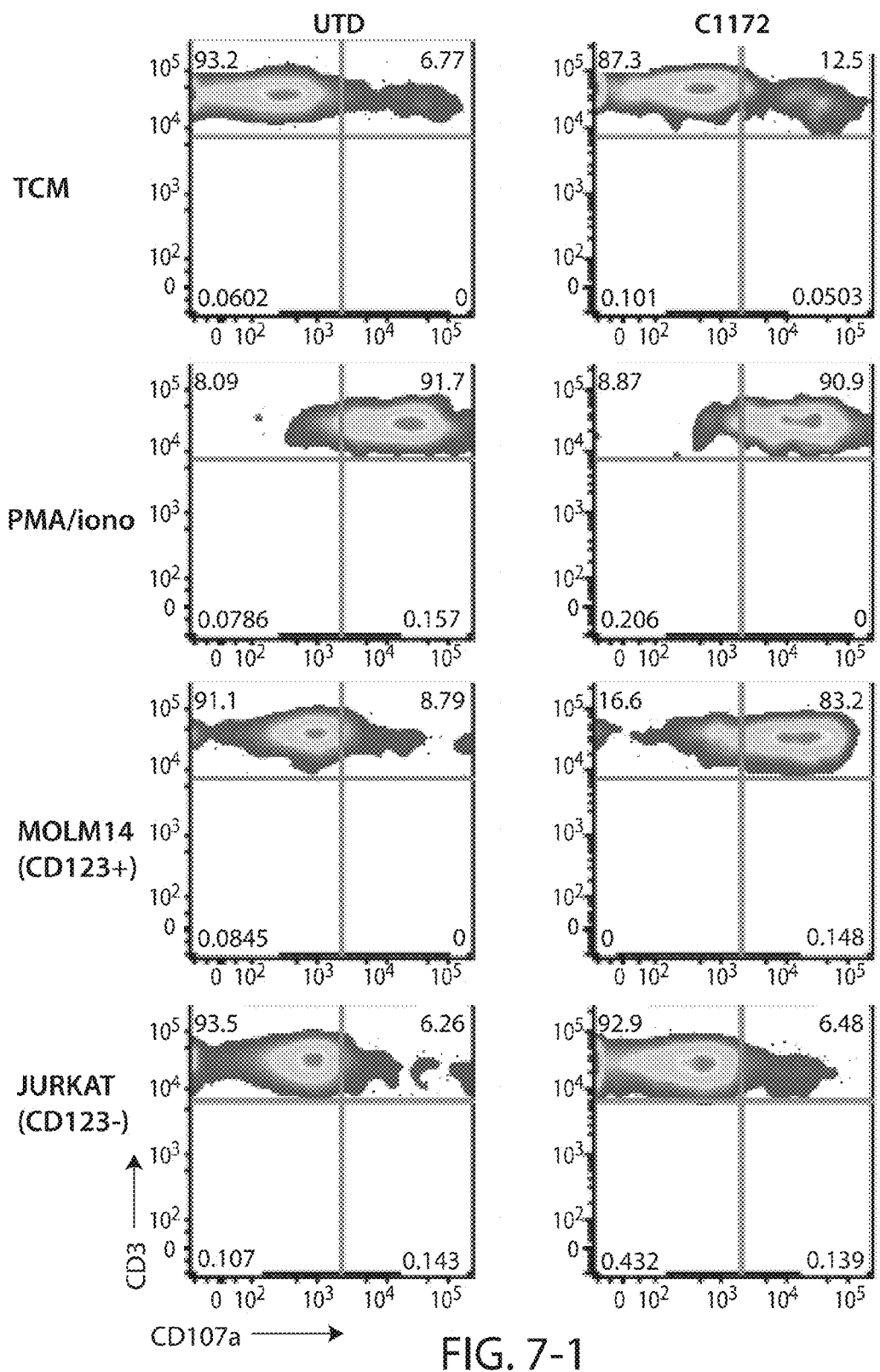
FIG. 7 (provided in FIGS. 7-1, 7-2, and 7-3) shows the degranulation of CD123 CARs 2-4 and 1172 and 1176 upon exposure to CD123+ tumor cells.
Figures 2, 7:
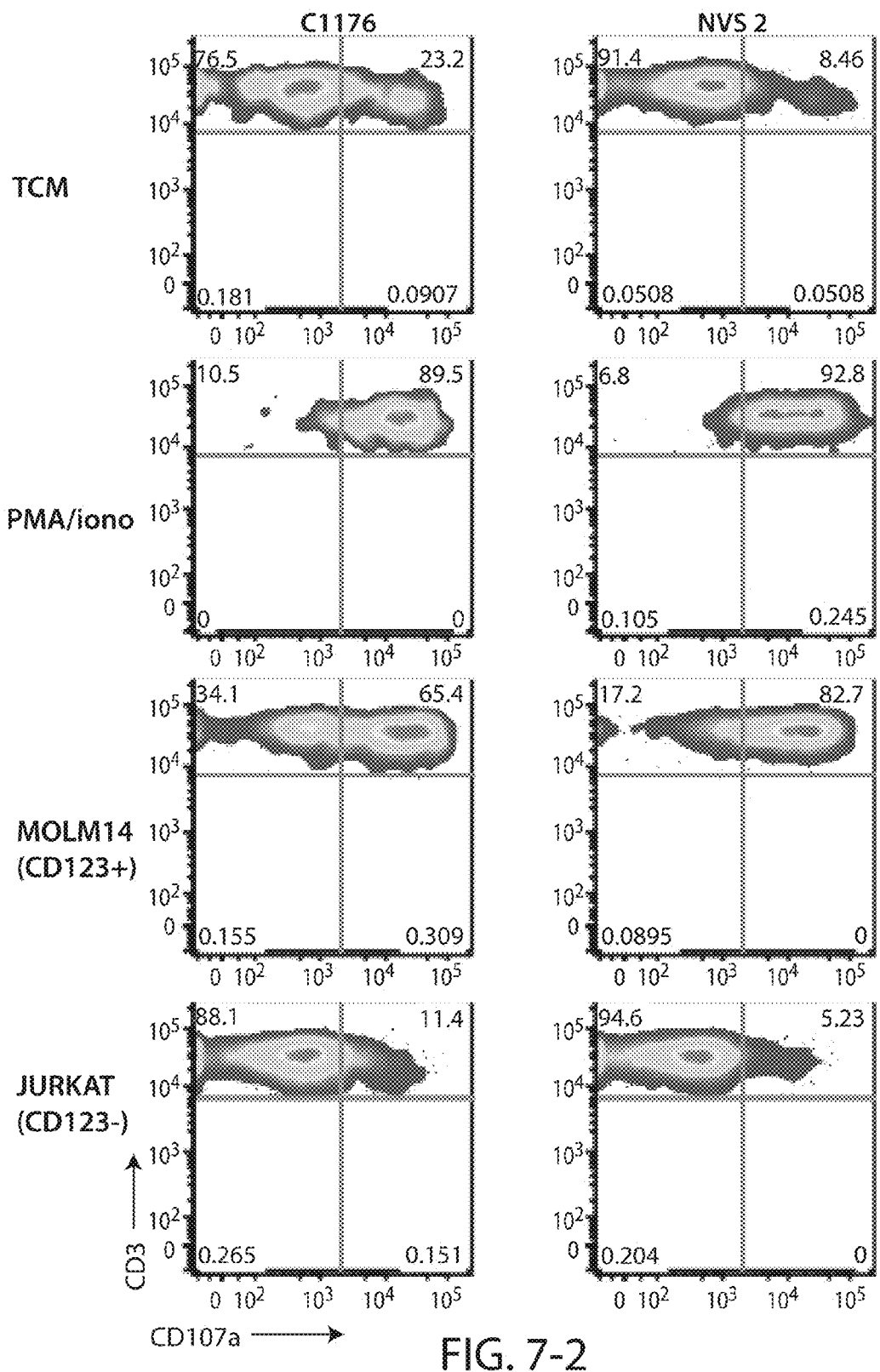
Figures 3, 7:
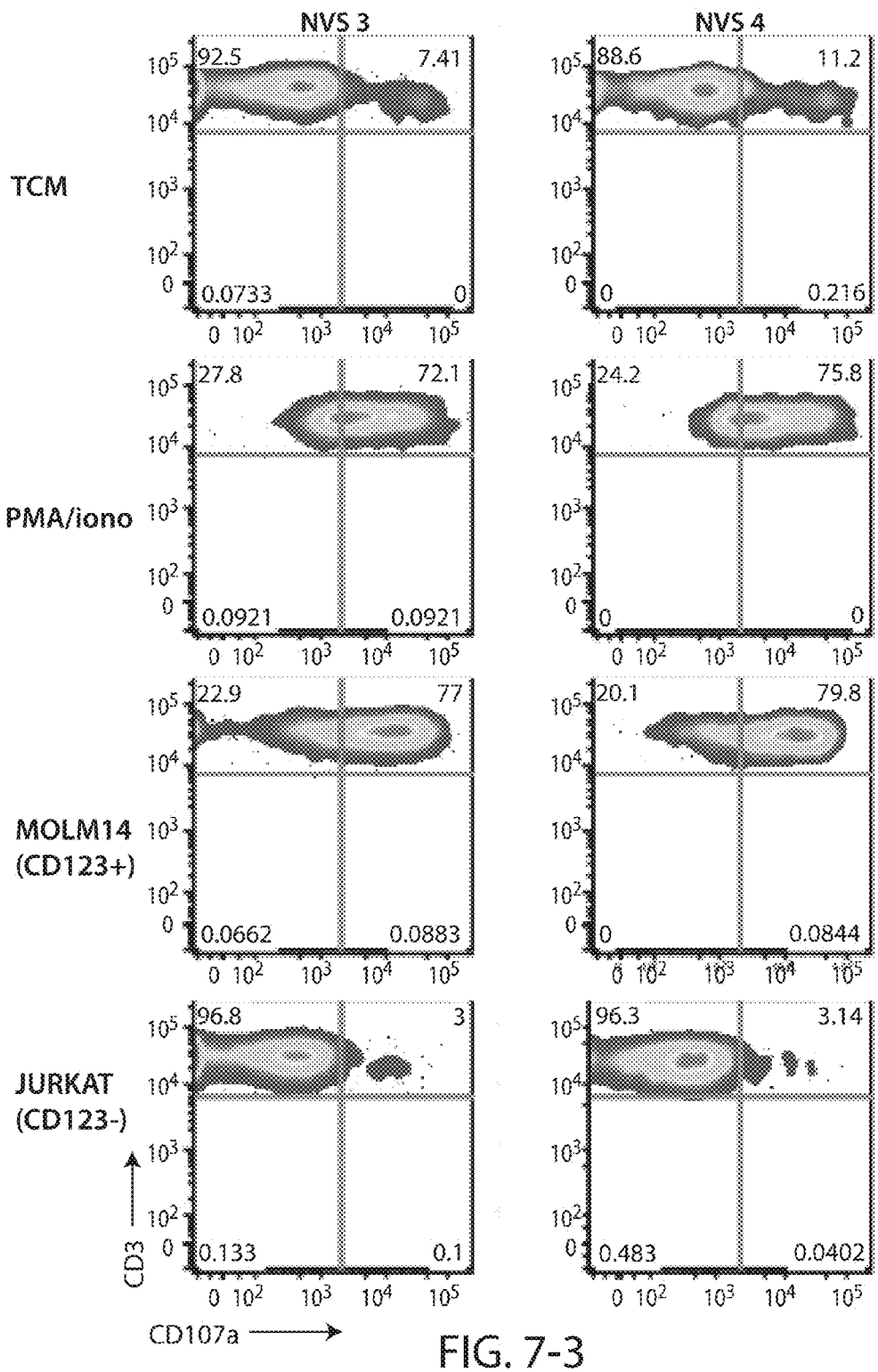

T cell degranulation is indicated in the upper right quadrant of each plot of FIG. 7. The results presented herein demonstrate similar T cell recognition of CD123+ targets, manifested by similar degranulation during a 2-hr in vitro assay. C1176 had inferior degranulation of 65% compared with approximately 80% in the other clones.

Cytotoxicity

Figure 8:
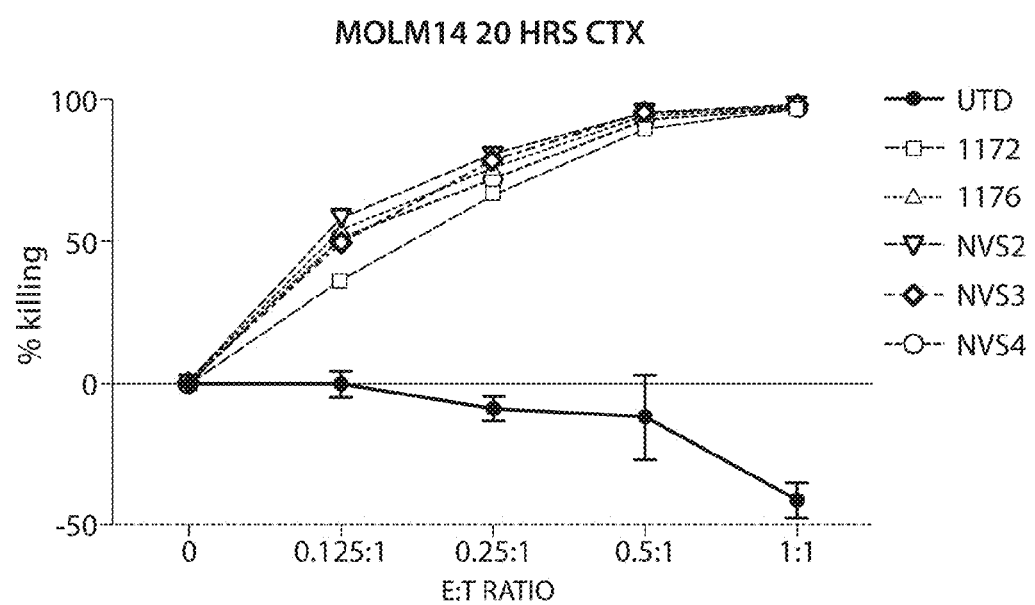
FIG. 8 shows a graphical representation of a luciferase assay to assess cytotoxicity of CART cells (NVS 2-4, 1172 and 1176 clones) towards tumor target cells (MOLM14).

To assess cytotoxicity, CART cells (NVS 2-4, 1172 and 1176 clones) were thawed and rested overnight at $2e^6$ cells/ml in T cell media. Cells were counted and resuspended at $1e^6$ cells/ml the following day. Tumor target cells (MOLM14) were resuspended at $1e^6$ cells/ml. Cells were plated in a black, flat-bottom 96 well plate at decreasing E:T ratios as indicated (FIG. 8), in duplicate. After 20 hours of incubation, luciferin was added and the plate was imaged to determine photon flux as a measure of residual live cells. Killing of MOLM14 cells was equivalent between all clones at most effector:target ratios at 20 hours.

In Vivo Mouse Model

Figure 9:
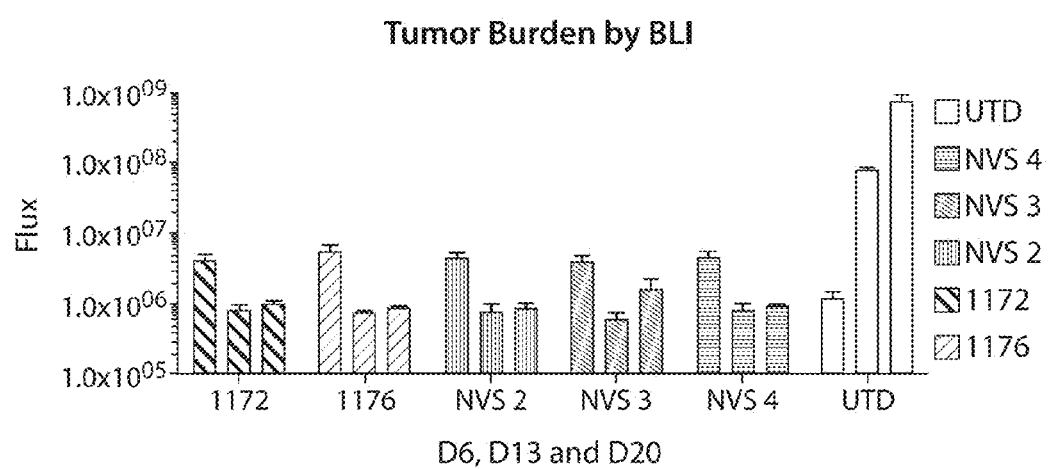
FIG. 9 shows a comparison of tumor burden in NSG mice injected with luciferase expressing MOLM14 cells at D6 (before CART injection) and at day 13 (6 days post injection with NVS 2-4, 1172 or 1176 clones) or at day 20.

NSG mice were injected iv with $1e^6$ luciferase expressing MOLM14 cells on D0. On D6 mice were imaged (IVIS Spectrum) for tumor burden and randomized into treatment groups. Mice with the lowest tumor burden were assigned to the control group (untransduced T cells, UTD). CART cells (NVS 2-4, 1172 and 1176 clones) or control T cells (1e6) were injected i.v. on D7. Data from imaging on performed D13 is shown in FIG. 9. Six days after injection, all anti-CD123 constructs provided equal anti-tumor effect, consistent with in vitro data.

Example 4

Humanized CAR Constructs

Humanized anti-CD123 single chain variable fragments (scFv) based on murine 1176 which is cross-reactive against cynomolgus CD123 were generated and cloned into a lentiviral expression vector with the intracellular CD3zeta chain and the intracellular co-stimulatory domain of 4-1BB and given the names depicted in Table 5 (provided in the Detailed Description).

The order in which the VL and VH domains appear in the scFv was varied (i.e., VL-VH, or VH-VL orientation), and where either three or four copies of the "G4S" (SEQ ID NO:25) subunit, in which each subunit comprises the sequence GGGGS (SEQ ID NO:25) (e.g., (G4S)$_3$ (SEQ ID NO:28) or (G4S)$_4$(SEQ ID NO:27)), connect the variable domains to create the entirety of the scFv domain, as shown in Table 6 (provided in the Detailed Description).

The sequences of the humanized scFv fragments (SEQ ID NOs: 184-215) CARs are provided herein in Table 6. These clones all contained a Q/K residue change in the signal domain of the co-stimulatory domain derived from CD3zeta chain. The CAR scFv fragments were then cloned into lentiviral vectors to create a full length CAR construct in a single coding frame, and using the EF1 alpha promoter for expression (SEQ ID NO: 11).

Example 5

CART123 in Hodgkin's Lymphoma

CD123 is known to be expressed in around 50% of classical Hodgkin's Lymphoma (HL) by flow cytometry. Exogenous administration of IL3 to Hodgkin's Lymphoma cell line cultures is known to promote growth and is able to partially rescue from cells from apoptosis by serum deprivation. Inhibition of CD123 (IL-3Ra) by SL-401 is known to to reduced viability of CD123++ HL cell lines (HDLM-2, L428).

8 patients with HL were analyzed for CD123 expression buy immunohistochemistry. As shown in Table 15, 4/8 samples showed positivity in Reed-Sternberg cells and/or in immune cell of the microenvironment.

TABLE 15

Target expression by IHC in 8 HL specimens

| UPN | CD30 | CD123 |
|---|---|---|
| 11-978 | + | − |
| 11-33317 | + | − |
| 13-4203 | + | − (histiocytes+) |
| 11-20838 | + | + |
| 11-4623 | + | − |
| 11-17638 D/E | + | + (subset) |
| 13-14768 | + | + |

Figure 10:
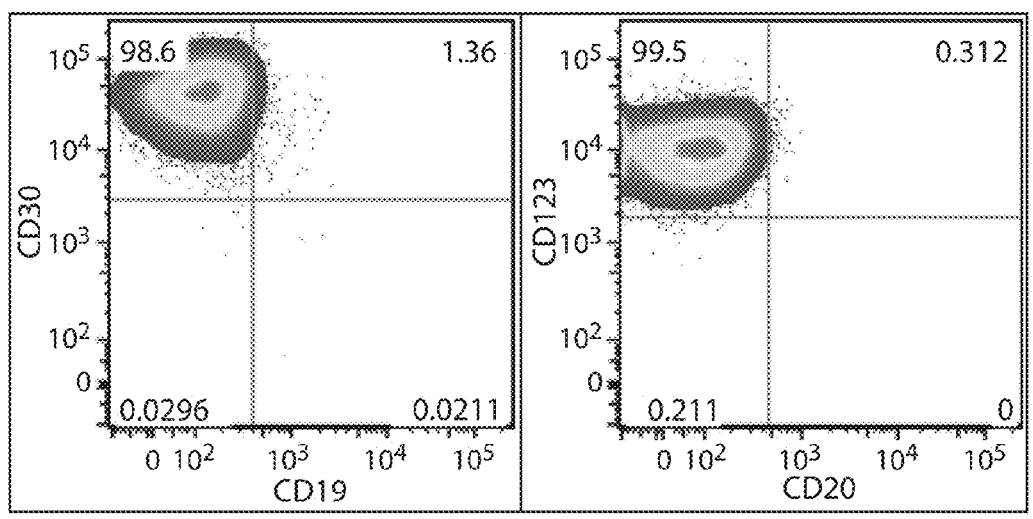
FIG. 10 shows expression of CD30 and CD123 in the Hodgkin's Lymphoma cell line HDLM-2.

Flow cytometry showed expression of CD30 and CD123 in a well-known Hodgkin's Lymphoma cell line HDLM-2 (FIG. 10). B-cell markers CD19 and CD20 were absent.

Figure 11A:
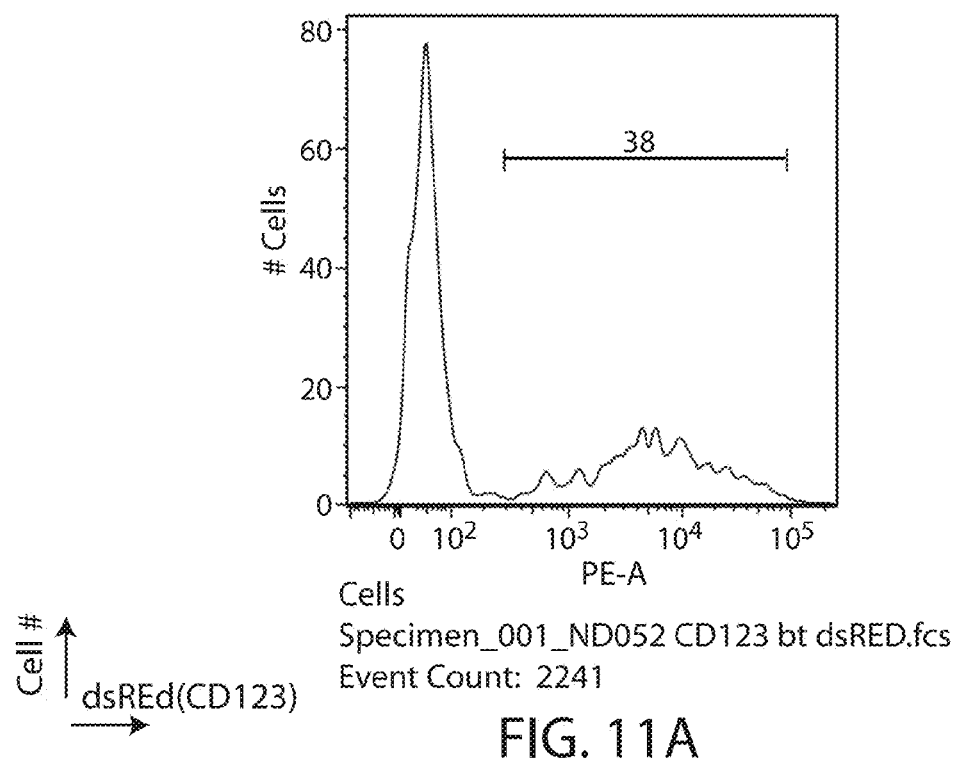
FIGS. 11A and 11B show CD123 CAR expression in T-cells transduced with pELNS anti-CD123-41BB-CD3 via detection of dsRed, a surrogate marker of CD123 by T2A coexpression. dsRed was detected via flow cytometry.
Figure 11B:
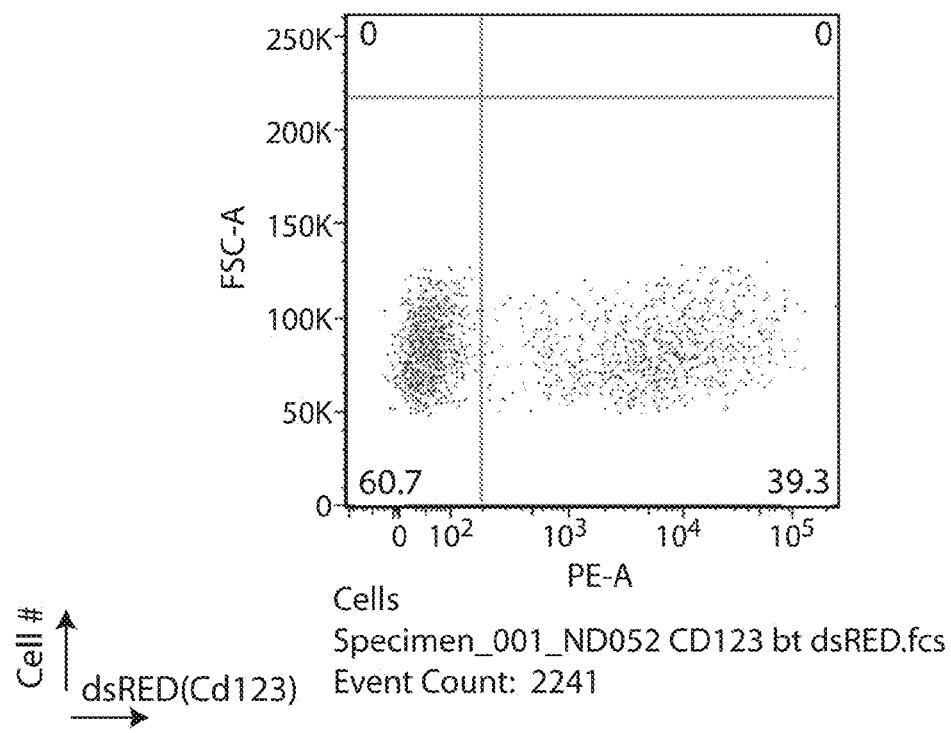

The experiments below use a pELNS anti-CD123-41BB-CD3 (CAR123) plasmid DNA with light-to-heavy or heavy-to-light chain orientations of the mouse anti-human CD123 scFv. T cells were obtained from a normal donor (ND052, Human Immunology Core), expanded using CD3/CD28 magnetic beads (Invitrogen) and transduced on day 2 with CAR123 lentivirus. At day 6 CD123 was detected via detecting dsRed, surrogate marker of CD123 by T2A coexpression. dsRed was detected via flow cytometry (FIG. 11A-B).

Figure 12:
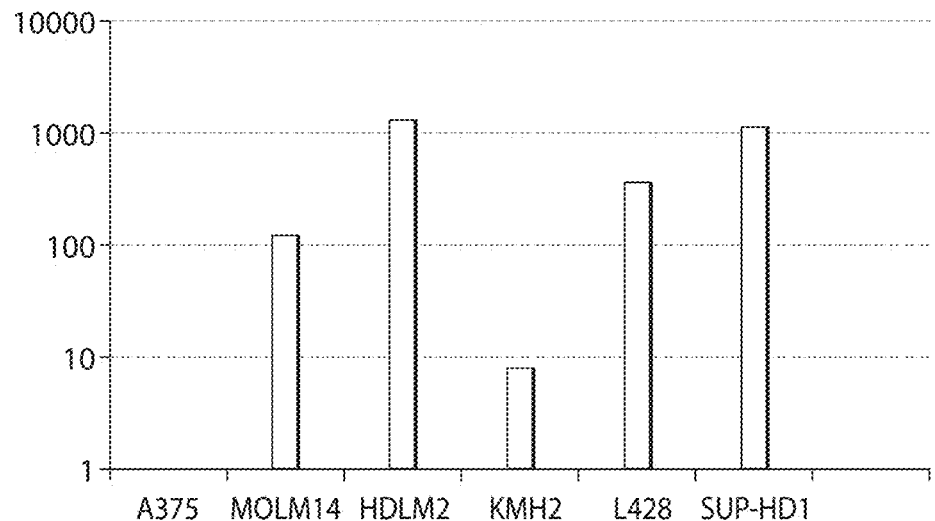
FIG. 12 shows Q-PCR on CD123 expression in 4 Hodgkin's Lymphoma cell lines (HDLM2, KMH2, L428, SUPHD1), CD123+ MOLM14 (positive control) and A375 (negative control). GUSB was used as a housekeeping gene. The Ct threshold was 40.

Q-PCR was then performed on CD123 expression in 4 Hodgkin's Lymphoma cell lines (HDLM2, KMH2, L428, SUPHD1), CD123+ MOLM14 (positive control) and A375 (negative control). CD123 was expressed in all Hodgkin's Lymphoma cell lines (FIG. 12). GUSB was used as a housekeeping gene. The Ct threshold was 40.

Role of IL-3 in Promoting HL Cell Growth

Figure 13:
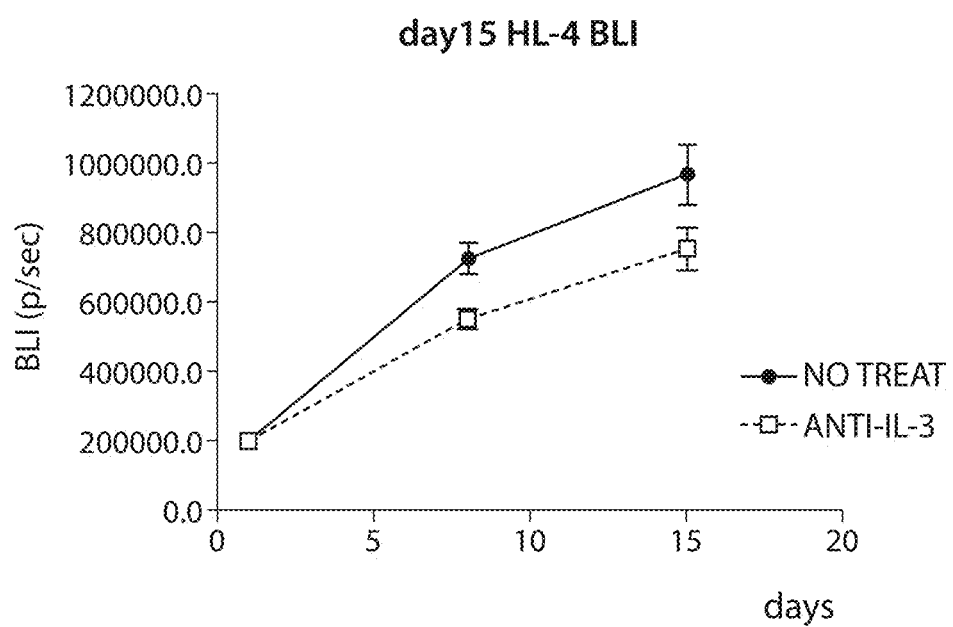
FIG. 13 shows the effect of IL3 antibody on an in vivo model for Hodgkin's Lymphoma. NOD-SCID-γ-chain KO mice that overexpress human cytokines including IL-3 (NSG-S mice) were engrafted with the luciferase-expressing HDLM-2 cell line. After i.v. injection, the neoplastic cells progressively formed disseminated soft tissue masses. Serial injections of a neutralizing anti-IL3 antibody slowed the growth of tumor.

As CD123 is the IL3 receptor a chain and IL-3 has important roles in hematopoietic growth and differentiation, it was investigated whether IL3 signaling is important in the growth of Hodgkin's Lymphoma cell lines. NOD-SCID-γ-chain KO mice that overexpress human cytokines including IL-3 (NSG-S mice) were engrafted with the luciferase-expressing HDLM-2 cell line. After i.v. injection, the neoplastic cells progressively formed disseminated soft tissue masses. Serial injections of a neutralizing anti-IL3 antibody slowed the growth of tumor. The results presented herein suggest that CD123 may be a particularly relevant target in Hodgkin's Lymphoma. Tumor burden is shown by BLI (FIG. 13).

CD107a Degranulation Assay

Untransducted T cells (UTD) or CART123 were incubated with HDLM-2 (CD123+ HL cell line) for 4 hours at a ratio of 5 target cells to 1 T cells in the presence of anti-CD28, anti-CD49d antibodies and monensin. Anti-CD30 CAR T cells were used as additional controls.

Figure 14:
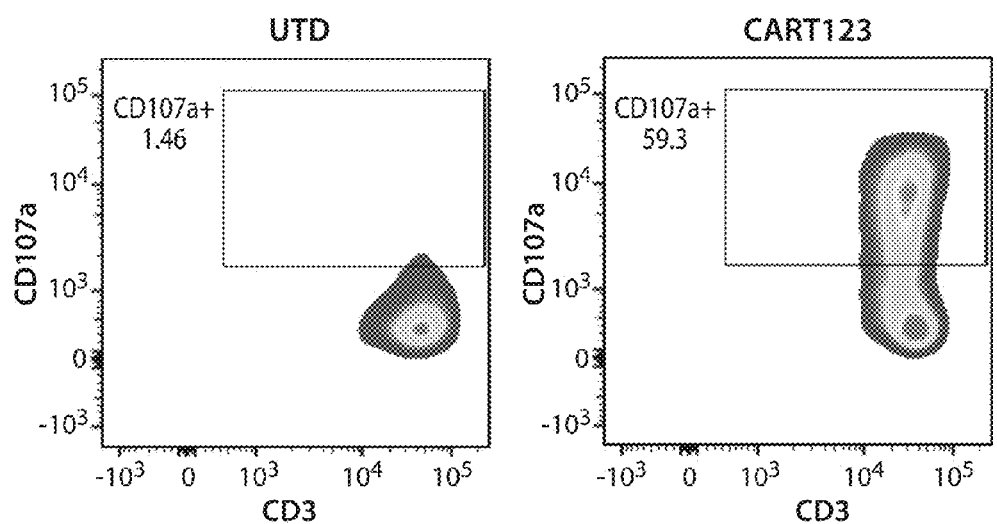
FIG. 14 shows a CD107a degranulation assay. Untransduced T cells (UTD) or CART123 were incubated with HDLM-2 (CD123+ HL cell line) for 4 hours at a ratio of 5 target cells to 1 T cells in the presence of anti-CD28, anti-CD49d antibodies and monensin. Anti-CD30 CAR T cells were used as additional controls. CART123 but not UTD showed increase CD107a degranulation as detected by flow cytometry.
Figure 15:
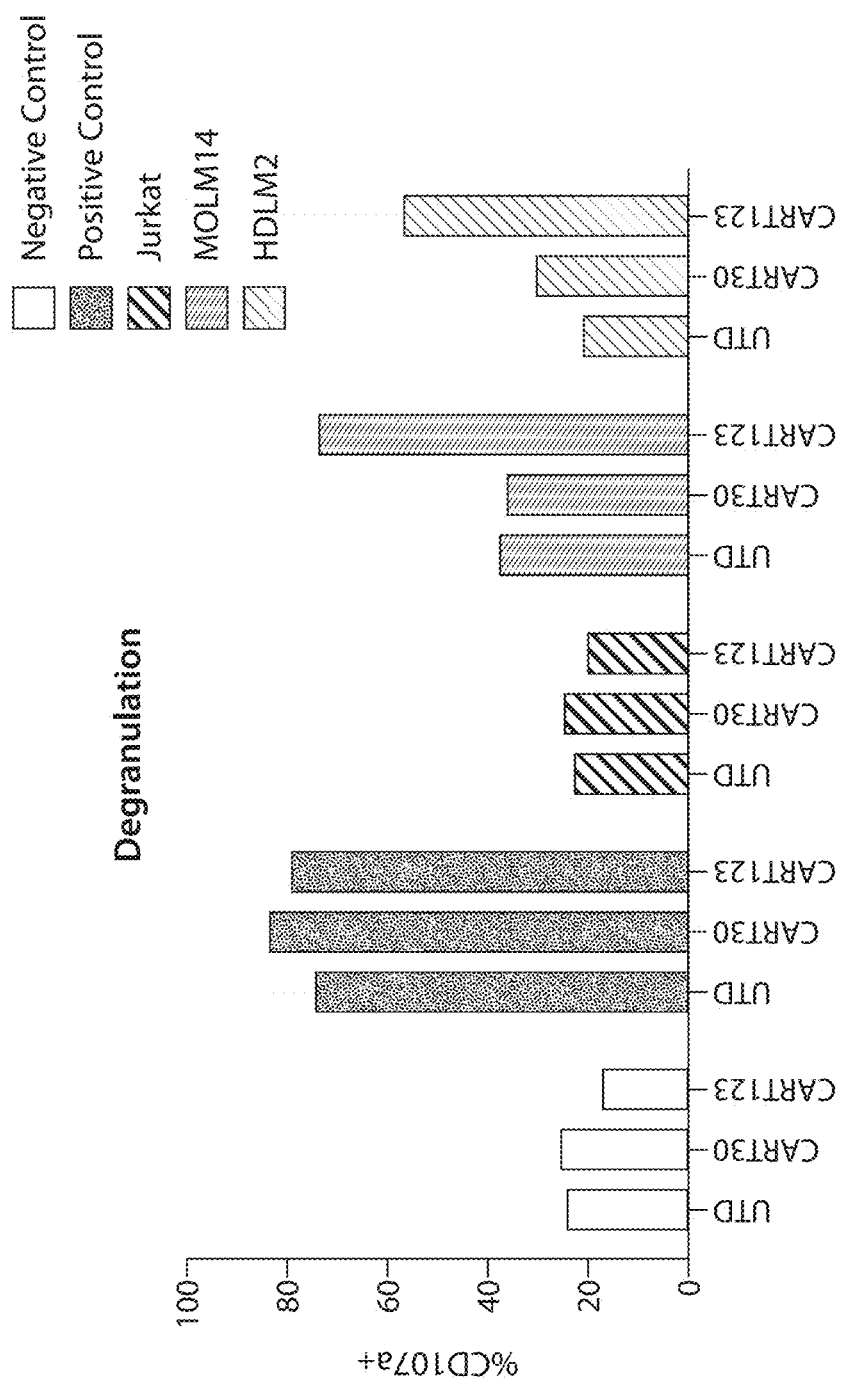
FIG. 15 shows a graphical representation of the degranulation assay shown in FIG. 20.
Figure 16:
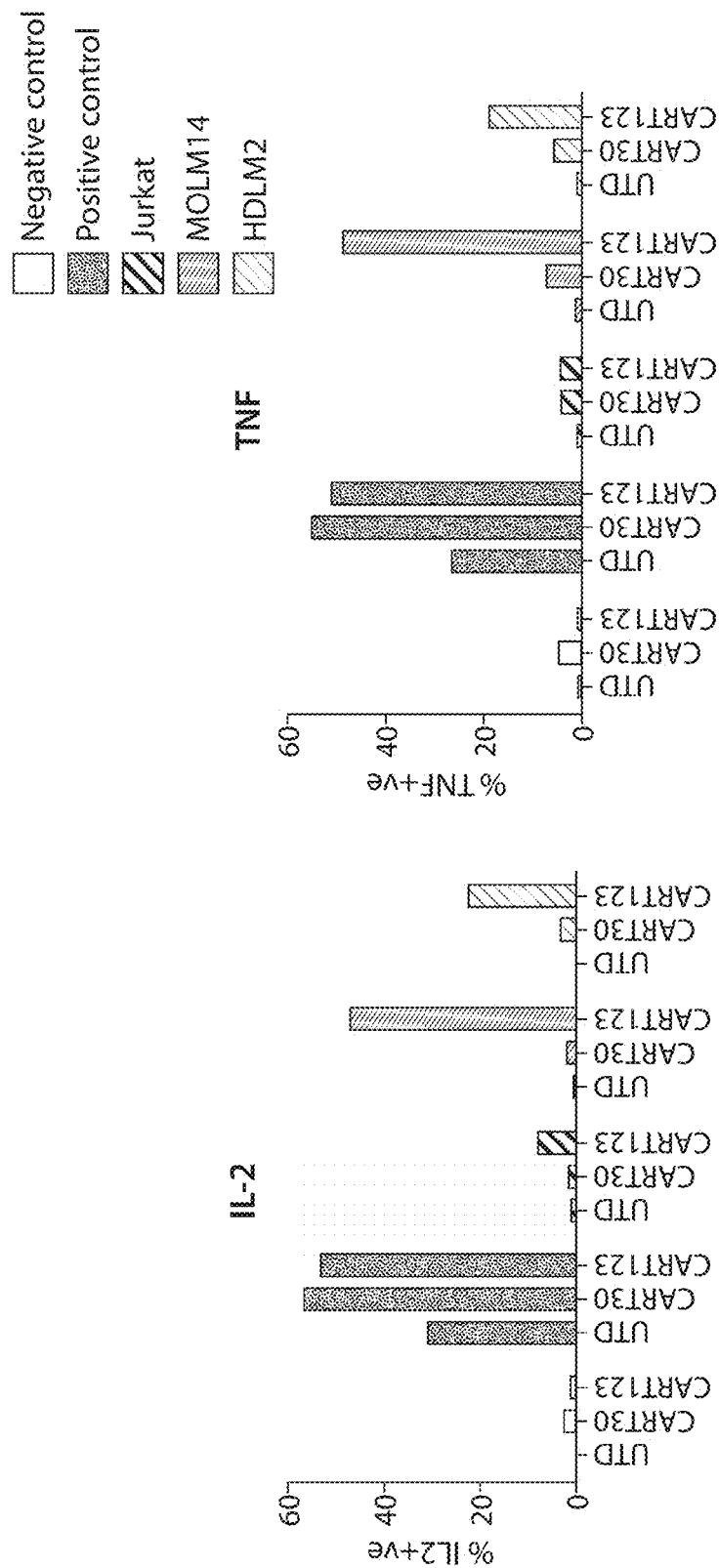
FIG. 16 demonstrates that CD123 CAR expressing T cells show a significant increase in intra-cytoplasmatic cytokine production (IL-2, TNF).

CART123 but not UTD showed increase CD107a degranulation as detected by flow cytometry (FIGS. 14 and 15). Moreover CART123 showed significant increase in intra-cytoplasmatic cytokine production (IL-2, TNF) (FIG. 16).

CART123 Kill HDLM-2 Cells

Figure 17:
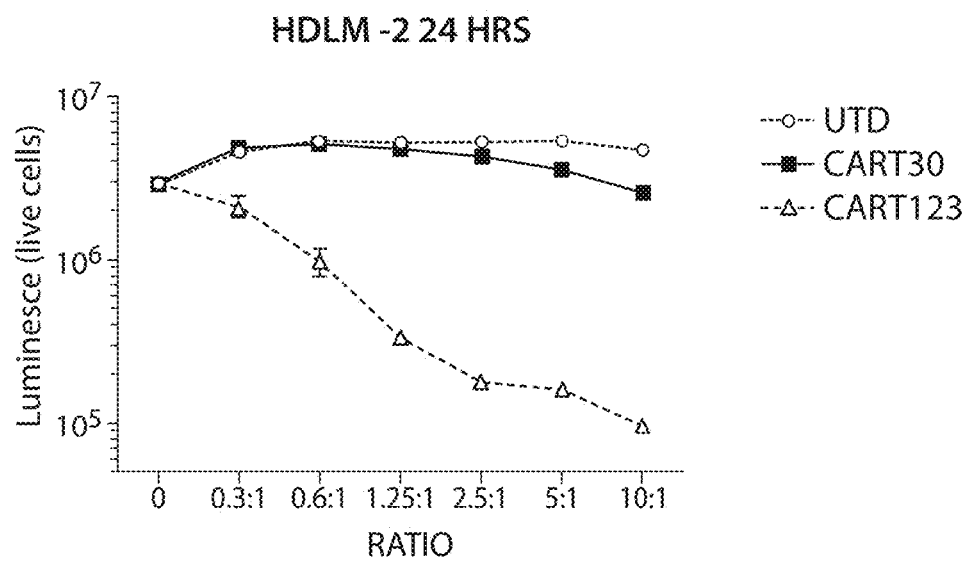
FIG. 17 demonstrates CART123, but not UTD, showed a dose dependent killing as shown by decrease in bioluminesce emission in a luciferase based 24 hr killing assay. T cells were co-incubated with luciferase+ HDML-2 cells at different rations (0.3:1-10:1).

A luciferase based 24 hr killing assay was performed. T cells were co-incubated with luciferase+ HDML-2 cells at different rations (0.3:1-10:1). CART123 but not UTD showed a dose dependent killing as shown by decrease in bioluminesce emission. Interestingly, CD30-specific CAR T cells showed minimal activity (FIG. 17).

CART123 Proliferate in the Presence of HL Cell Lines

Figure 18:
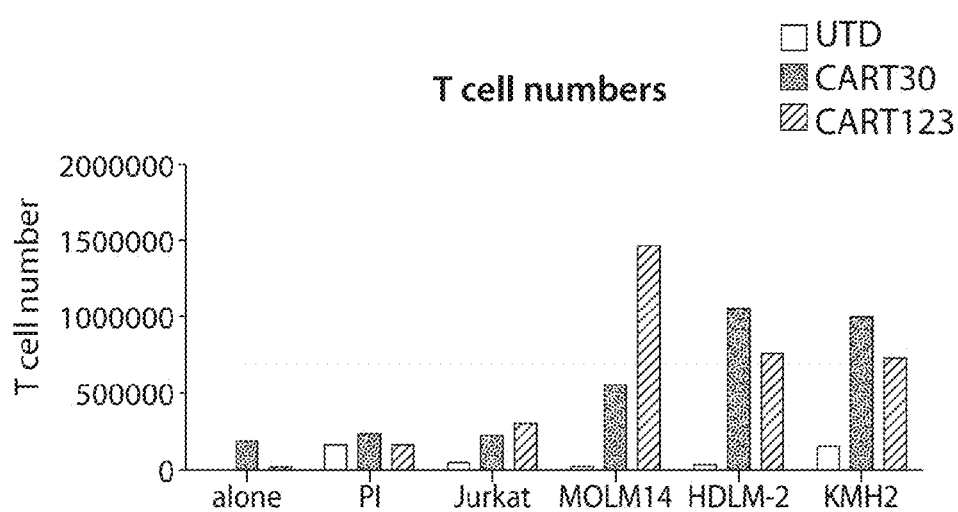
FIG. 18 shows CART123 and CART30 cells but not UTD showed robust proliferation when co-cultured with Hodgkin Lymphoma cell linesa proliferation assay. T cells were incubated with HL cell lines (CD123+) or controls (Jurkat CD123−, MOLM-14 CD123+) or PMA/Ionomycin (positive control) or cell media (negative control) in a 5-day T cell proliferation assay.
Figure 19A:
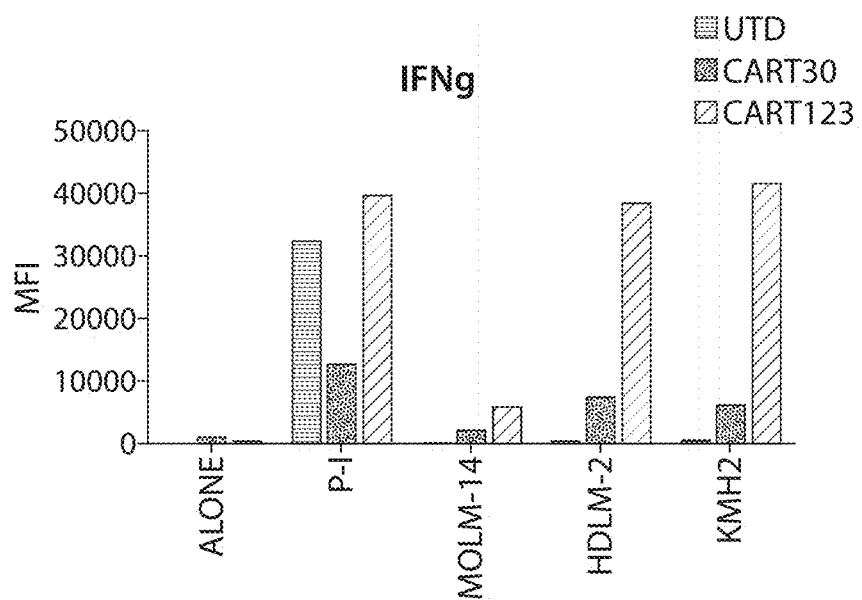
FIGS. 19A, 19B, 19C, and 19D show CART123 inducing robust production of IFNg (FIG. 19A), IL-2 (FIG. 19B), TNFa (FIG. 19C), and MIP1b (FIG. 19D) luminex MFI are shown.
Figure 19B:
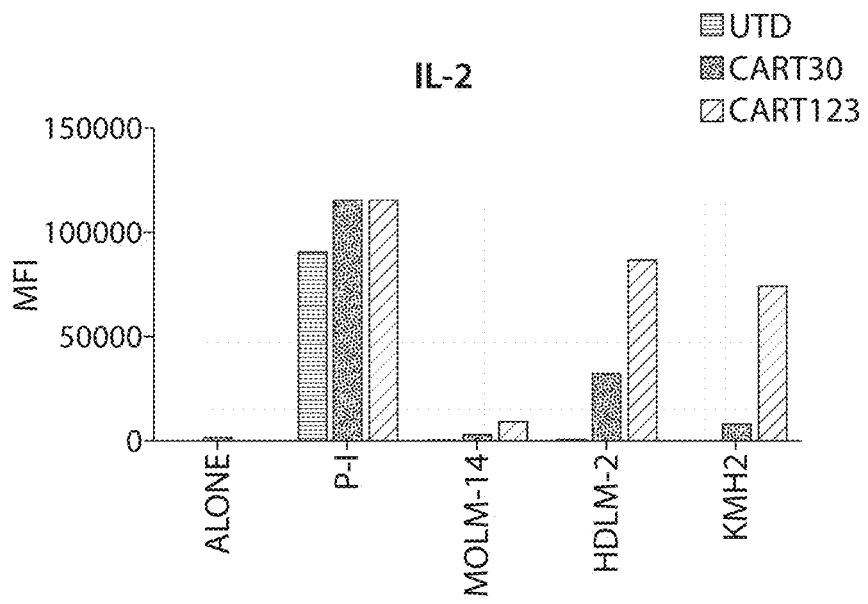
Figure 19C:
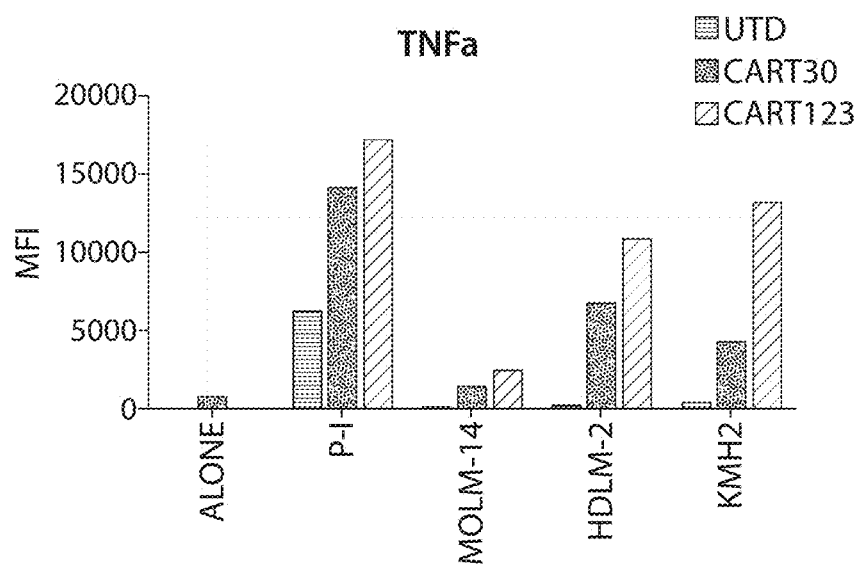
Figure 19D:
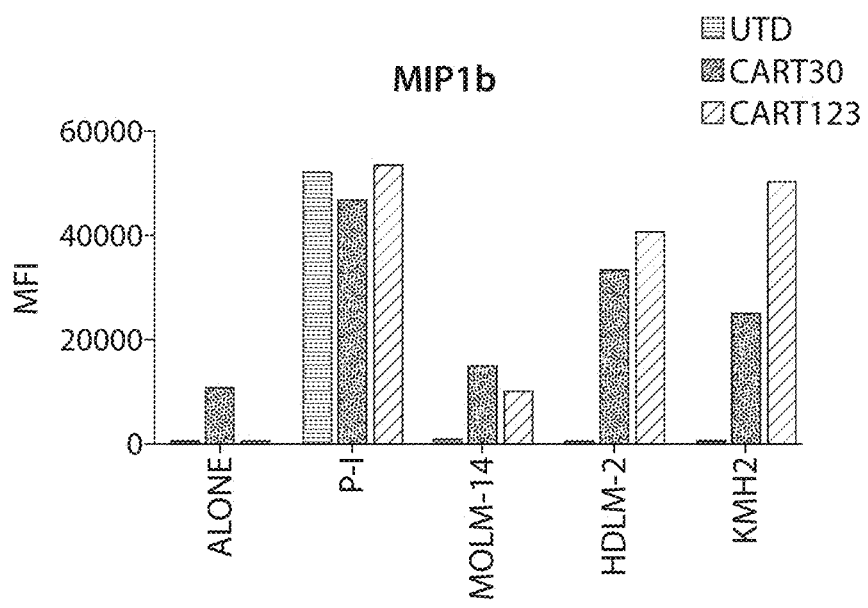

T cells were incubated with HL cell lines (CD123+) or controls (Jurkat CD123-, MOLM-14 CD123+) or PMA/Ionomycin (positive control) or cell media (negative control) in a 5-day T cell proliferation assay. CART123 and CART30 cells but not UTD showed robust proliferation when co-cultured with HL cell lines (FIG. 18)

Supernatant from the proliferation assay was collected after 72 hrs and the presence of 30 cytokines was analyzed by Luminex assay. CART123 showed robust production of multiple cytokines (IFNg, IL-2, TNFa and MIP1b luminex MFI are shown in the FIGS. 19A-19D, respectively).

In Vivo Efficacy of CART123 Against a Hodgkin's Lymphoma Cell Line (HDLM-2)

Figure 20:
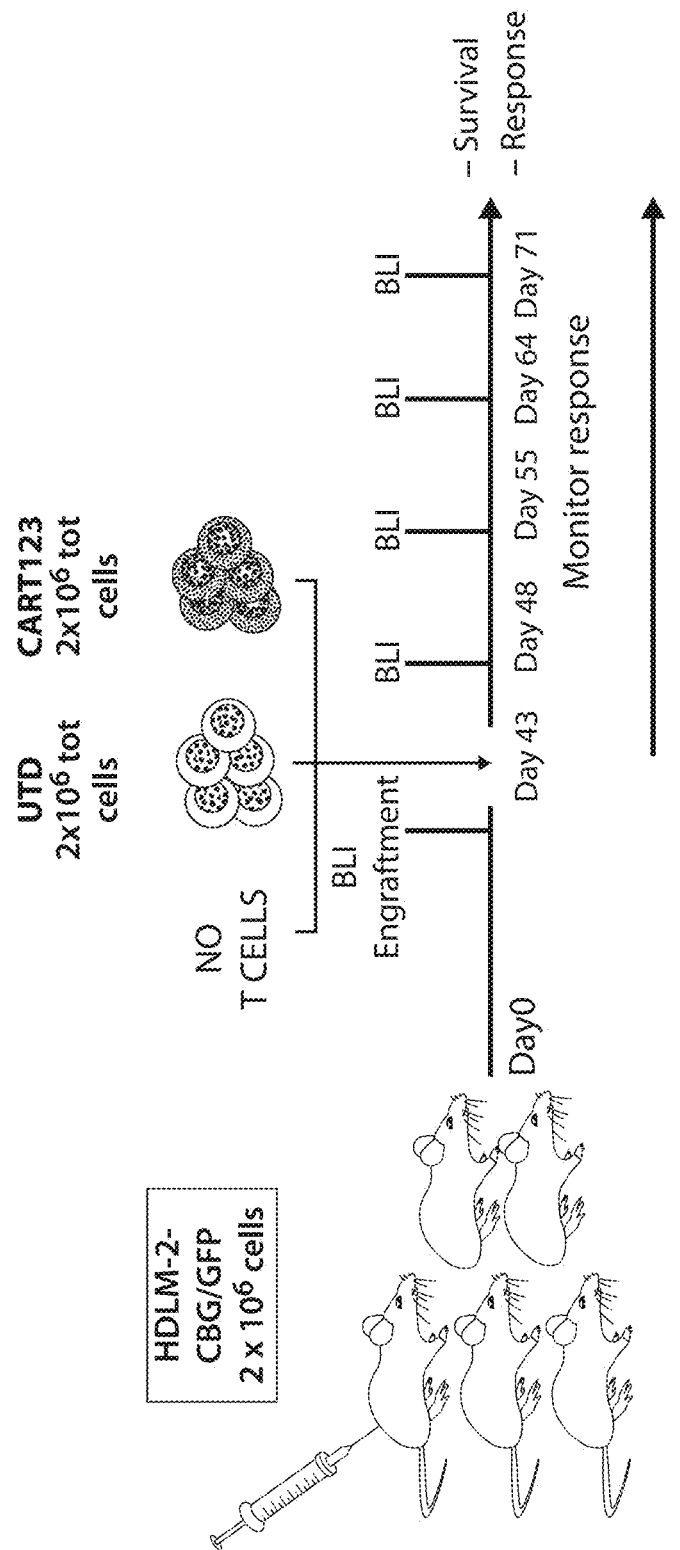
FIG. 20 shows a schematic representation of an in vivo model of Hodgkin Lymphoma. 1 million luciferase+ HDLM-2 cells were injected i.v. on day 0. Serial bioluminescent imaging (BLI) demonstrated was then performed to observe tumor level. A low level of tumor was observed on day 7, which was followed by gradual increase in tumor burden over approximately 6 weeks, reproducing the indolent nature of the human disease. At day 43 when the tumor burden was 20-fold higher than baseline, mice were treated with 1.5 million CART123 cells or control T cells.

To confirm the in vitro data presented herein, an in vivo model was developed. 1 million luciferase+HDLM-2 cells were injected i.v. on day 0. Serial bioluminescent imaging (BLI) demonstrated was then performed to observe tumor level (FIG. 20) A low level of tumor was observed on day 7, which was followed by gradual increase in tumor burden over approximately 6 weeks, reproducing the indolent nature of the human disease. At day 43 when the tumor burden was 20-fold higher than baseline, mice were treated with 1.5 million CART123 cells or control T cells.

Figure 21:
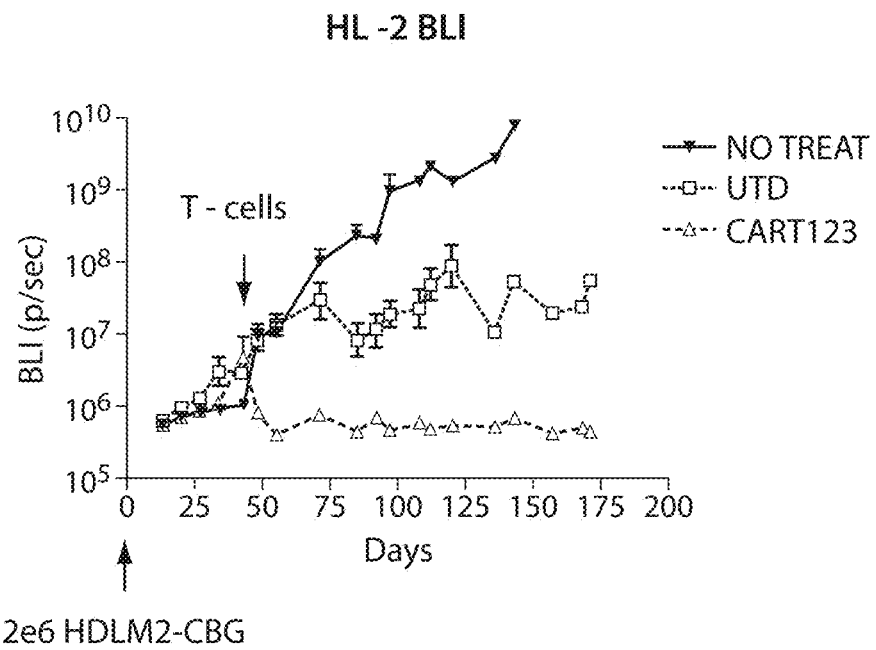
FIG. 21 shows BLI to detect HDLM-2 at days post-injection in mice treated with CART123 cells, control T cells, or untreated, according to the schematic in FIG. 28.
Figure 22:
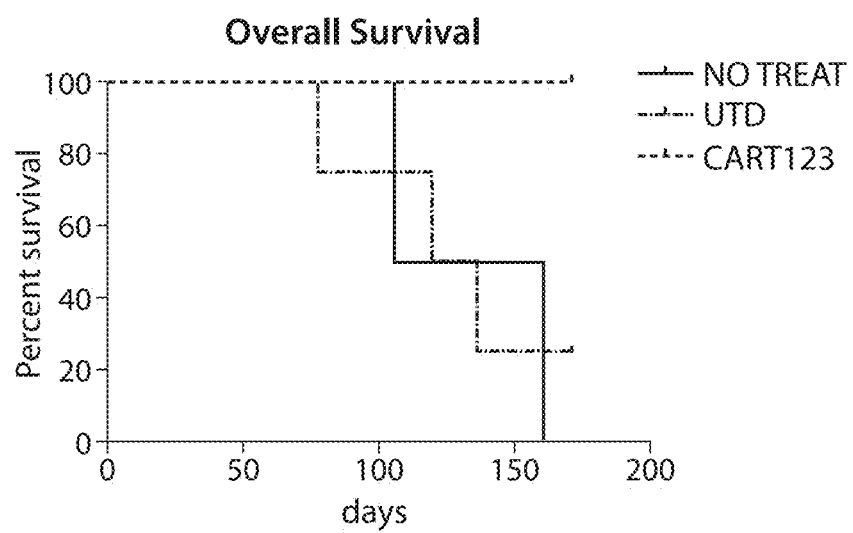
FIG. 22 shows survival of mice treated according to the schematic shown in FIG. 28, CART123 induced complete and durable eradication of disseminated tumor within 14 days, leading to 100% relapse-free and 100% overall survival at 6 months.

CART123 induced complete and durable eradication of disseminated tumor within 14 days, leading to 100% relapse-free and 100% overall survival at 6 months (FIGS. 21 and 22).

Figure 23:
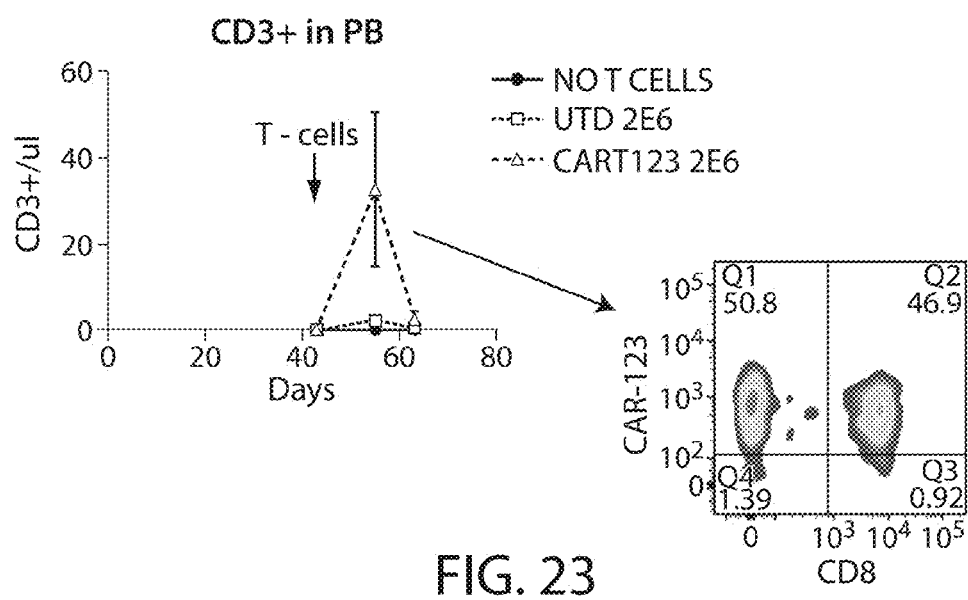
FIG. 23 shows an association between tumor elimination and extensive CAR T cell expansion as detected by flow cytometry in serial peripheral blood bleedings. The expanded T cells were approximately 50% CD8 and 50% CD4 cells. The T cell number contracted over time as tumor burden decreased.

Tumor elimination was associated with extensive CAR T cell expansion as detected by flow cytometry in serial peripheral blood bleedings (FIG. 23). The expanded T cells were approximately 50% CD8 and 50% CD4 cells. The T cell number contracted over time as tumor burden decreased.

Example 6

Additional Characterization of CD123-2 CAR

Figure 25:
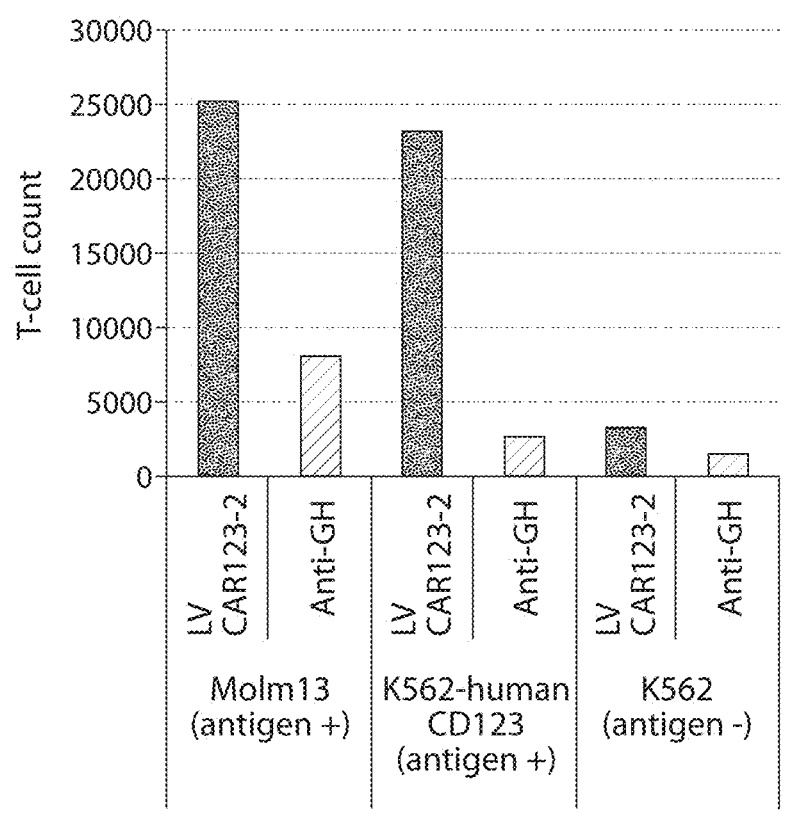
FIG. 25 is a bar graph showing the proliferation capacity of lentivirally transduced T cells expressing CAR123-2 (LV CAR123-2) or control anti-GH when cultured in the presence of target cells MOLM13 (which express CD123), K562-human CD123 (which express human CD123), or K562 (which do not express CD123).

Additional in vitro assays were performed to evaluate primary T cells that were lentivirally transduced to express the CAR123-2 construct (also referred to herein as LV CAR123-2). The CAR-expressing T cells (LV CAR123-2) were compared to T cells expressing an scFv against cytomegalovirus (hCMV) glycoprotein H (gH) (referred to herein as anti-GH), which acted as a negative control. Key in vitro assays included cytokine production, proliferation, and cell killing assays. Proliferation assays were performed by incubating T cells (LV CAR123-2 or anti-GH) with CD123-expressing (antigen+) cell lines, e.g., MOLM13 or K562 expressing human CD123, or CD123-negative (antigen−) control cell lines, e.g., K562. The T cells were grown for 4 days. As shown in FIG. 25, the CAR-expressing cells exhibited robust proliferation compared to the negative control when cultured in the presence of CD123-expressing cells.

The ability of CAR123-2-expressing T cells to kill target cells was measured as a titration of target:effector cell ratios ranging from 1:20 and two-fold dilutions to 1:0.3125. The target cells that were tested were CD123-expressing MOLM13 cell lines that stably express luciferase, PL21 cells that stably express luciferase, and U87 cells that stably express luciferase. As shown in FIGS. 26A and 26B, the CD123-CAR expressing cells demonstrate targeting killing of CD123-expressing cancer cells (MOLM13 and PL21), while the negative control (cells expressing anti-GH) and untransduced cells (UTD) do not demonstrate targeted killing. In FIG. 26C, UTD, negative control (anti-GH) and the CD123 CAR-expressing cells did not demonstrate specific killing of U87 cells (which do not express CD123).

Figure 27A:
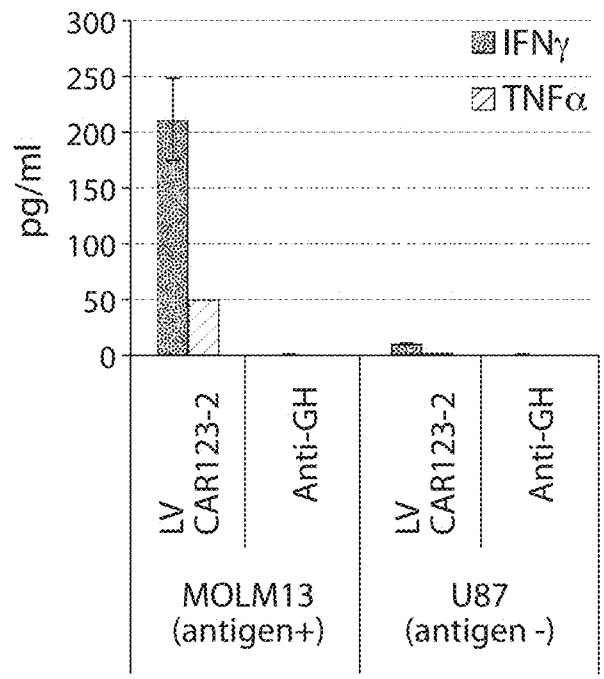
FIGS. 27A and 27B are graphs showing cytokine production from lentivirally transduced T cells expressing either a CAR123 (LV CAR123-2) or control (Anti-GH) when cultured in the present of target cells MOLM13 (which express CD123) and U87 (which do not express CD123).
Figure 27B:
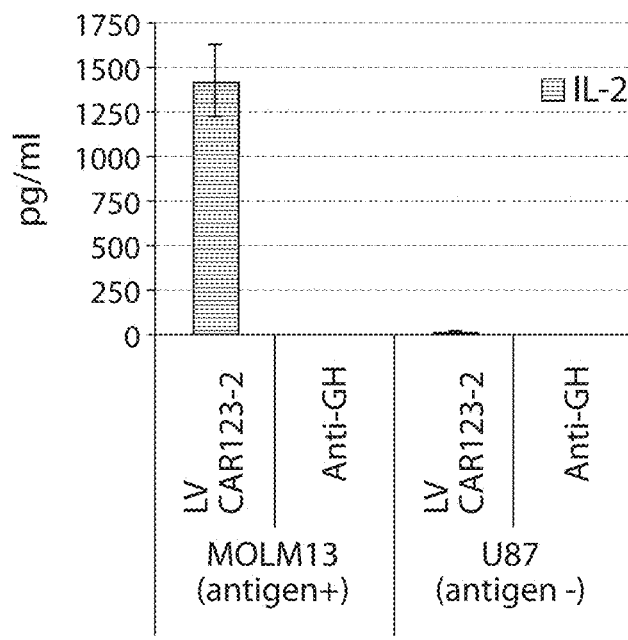
Figure 28:
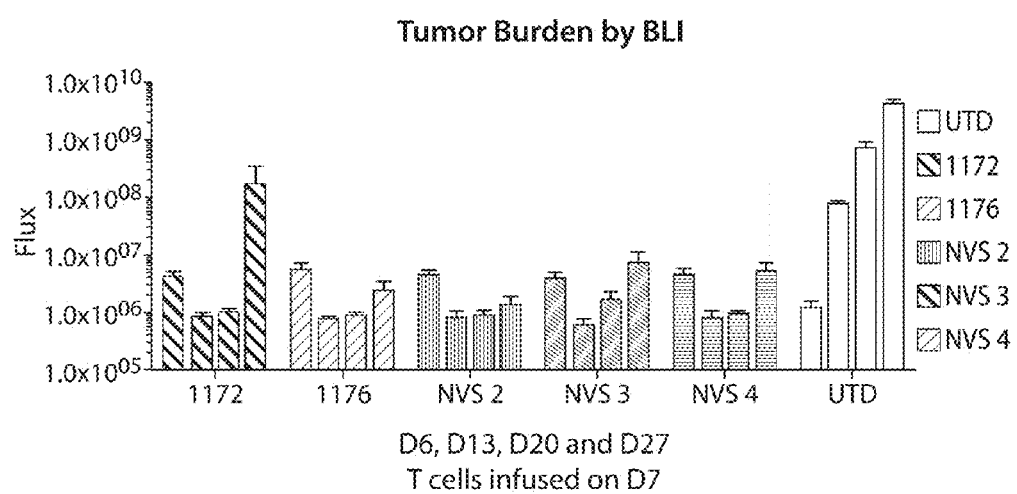
FIG. 28 shows the tumor burden in an in vivo mouse model of Hodgkin lymphoma, where the mice bearing tumors were administered T cells expressing various CAR123 constructs: 1172, 1176, NVS2 (also referred to herein as CAR123-2), NVS3 (also referred to herein as CAR123-3), and NVS4 (also referred to herein as CAR123-4). Tumor burden at day 6, day 14, day 20, and day 27 were measured and represented by bioluminescent imaging (BLI).
Figure 29:
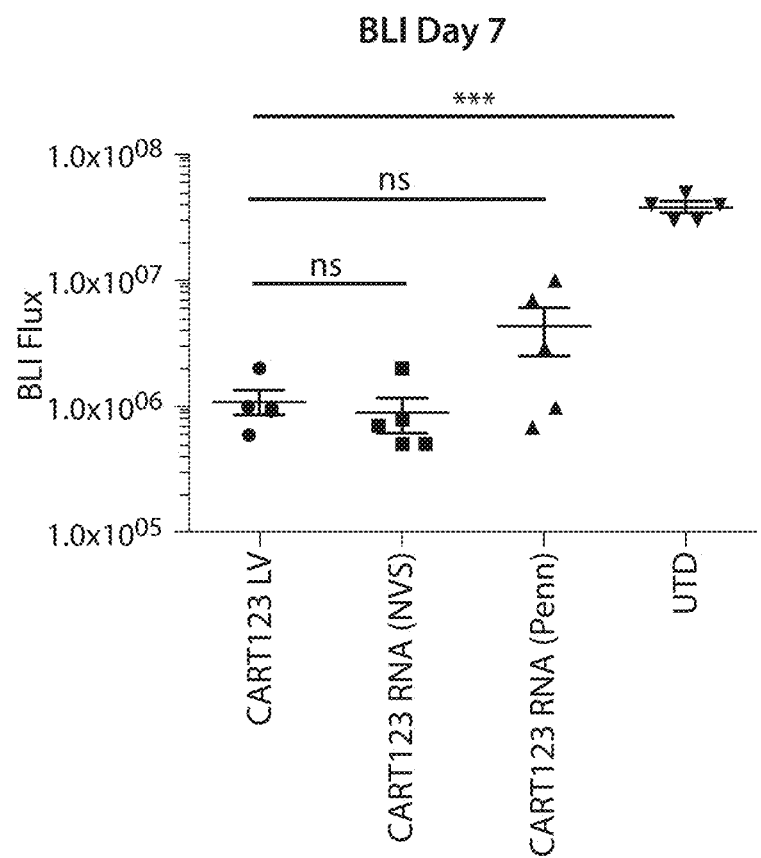
FIG. 29 shows the tumor burden in an in vivo mouse model, where the mice bearing tumors were administered T cells expressing CAR123-2 introduced from a lentiviral vector (CART123 LV), CAR123-2 introduced as RNA (CART123 RNA (NVS)), and a tool CAR123, introduced as RNA (CART123 RNA (Penn)). Untransduced T cells were used as control (UTD). Tumor burden is represented by bioluminescent imaging (BLI) units.
Figure 30A:
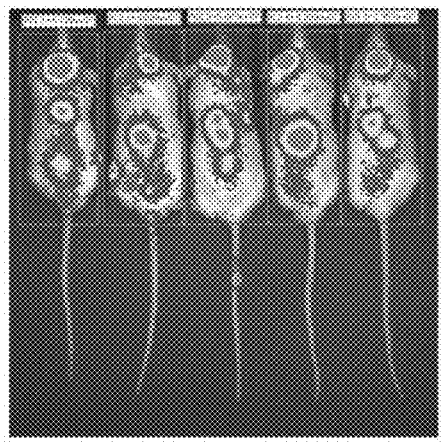
FIGS. 30A, 30B, 30C, and 30D show bioluminescent imaging of the tumors in an in vivo mouse model.
Figure 30B:
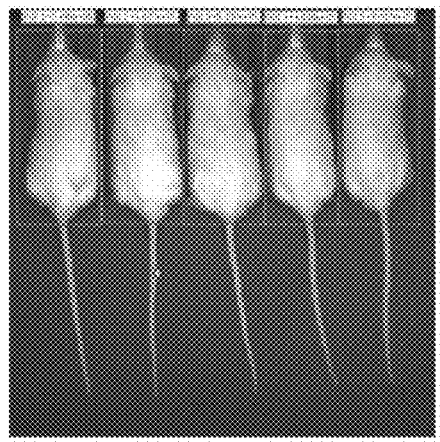
Figure 30C:
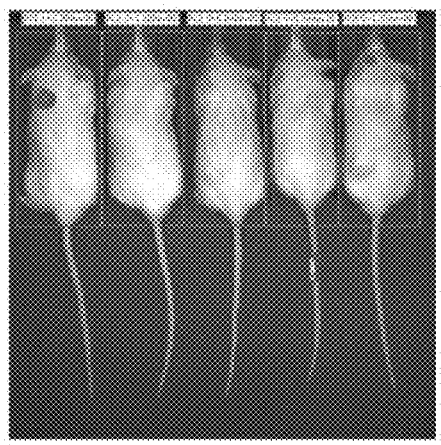
Figure 30D:
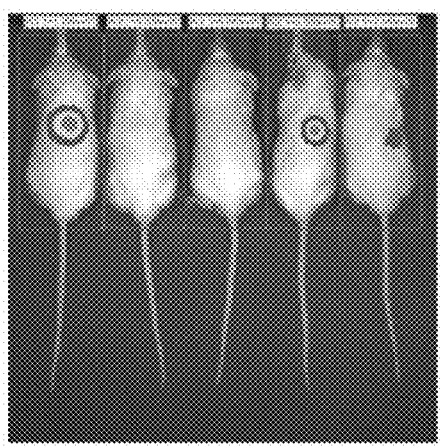

A cytokine production assay was performed by analyzing the supernatant from co-cultures comprising T cells (expressing either CAR123-2 or anti-GH) with antigen positive (MOLM13) or antigen negative (U87) cells. CD123-CAR T cells showed robust cytokine production of IFN-gamma (FIG. 27A) and IL-2 (FIG. 27B).

Example 7

Combination of Anti-CD123 and Anti-CD19 CAR T Cells for the Treatment and Prevention of Antigen-Loss Relapse Chemo-refractory or relapsing (r/r) B-cell acute lymphoblastic leukemia (B-ALL) is associated with a poor prognosis but, as demonstrated recently, remains exquisitely sensitive to the immune system. In particular, anti-CD19 chimeric antigen receptor T cells (CART19, CTL019) and bi-specific anti-CD19/CD3 antibodies (blinatumomab) generate unprecedented complete response rates of 45-90% in this patient population. Both approaches re-direct autologous T cells to recognize CD19-expressing cells. Blinatumomab uses a continuous long-term infusion of a bispecific construct that combines an anti-CD19 single chain variable fragment (scFv) with an anti-CD3 scFv; in the case of CART19 T cells are genetically modified to express an anti-CD19 scFv fused to the T cell receptor signaling with built-in co-stimulatory domains. A recent study showed that 90% of patients with r/r B-ALL treated with CTL019 reach complete remission (CR) with an overall survival (OS) of 78% at 6 months. Encouraging results with CART19 were also obtained in patients with other B-cell neoplasms, such as chronic lymphocytic leukemia and non-Hodgkin lymphoma.

However, a subset of patients treated with CART19 or blinatumomab develops relapse and a significant portion of these relapses are characterized by the loss of CD19. In B-ALL, CD19-negative relapses have been reported in 10-20% of patients following CART19 or blinatumomab therapies and it has not been described in the setting of other treatments; overall about 30% of relapses after blinatumomab and up to 50% after CART19 are CD19-negative. CD19 is a prototypic B-cell marker that is expressed from the very earliest stages of B cell development to the mature B-cell. CD19 plays an important role in B cell biology as CD19-deficient B cells exhibit selective growth disadvantage. Thus the absence of CD19 is a very unusual finding in B-ALL and it is has been reported in only rare patients prior to the era of potent CD19-directed immunotherapies. The possible mechanism of antigen loss is currently under investigation and is most likely caused by selective pressure on leukemia sub-clones by these powerful anti-CD19 agents. Because of the recent approval by the FDA of blinatumomab and the breakthrough status accorded to CTL019, it is likely that increasing numbers of patients with r/r B-ALL will be treated with these agents. Hence, novel effective strategies are needed in order to be able to treat those patients that will relapse with CD19-negative blasts after CART19 or blinatumomab. Ideally a new approach would not only treat patients with active antigen-loss relapse but if employed upfront could potentially prevent their occurrence.

The interleukin-3 receptor alpha (or CD123) is involved in hematopoiesis and has been shown to be expressed in several hematologic neoplasms, including acute myeloid leukemia (AML), acute lymphoid leukemia (ALL), plasmacytoid dendritic cell neoplasm, hairy cell leukemia, and Hodgkin lymphoma. Unlike lineage-associated surface antigens such as CD33 (myeloid) or CD19 (B-lymphoid), CD123 is hierarchically expressed on hematopoietic progenitor cells and in AML CD123 is expressed on leukemic stem cells that are involved in resistance to chemotherapy and relapse after initial treatment. Due to these characteristics, CD123 has generated great interest for targeted therapy, and multiple agents are being developed such as the IL3-diphtheria toxin fusion protein (SL-401, DT388IL3), naked anti-CD123 monoclonal antibodies (CSL-360, CSL-362), antibody-drug conjugates, bi-specific antibodies or CD3Fv-IL3 fusion constructs, and more recently, anti-CD123 chimeric antigen receptor T cells. Some of these approaches are currently being validated in clinical trials and many more will be tested in the clinic in the next few years. Targeting CD123 with chimeric antigen receptor T cells (CART123) can lead to deep and long-term responses in human primary AML xenografts and can establish an anti-leukemia T cell memory. Here, CD123 is expressed in CD19-negative B-ALL relapses occurring after CD19-directed therapies and that CAR-123 T cells combined with CART19 (CTL019) is an effective therapy for the treatment and for the prevention of antigen-loss relapses in B-ALL xenografts.

Materials and Methods

Cell lines and primary samples. Cell lines were originally obtained from ATCC (Manassas, Va.) (K-562) or DSMZ (Braunschweig, Germany) (MOLM-14 and NALM-6). All cell lines were tested for the presence of *mycoplasma* contamination (MycoAlert™ *Mycoplasma* Detection Kit, LT07-318, Lonza, Basel, Switzerland). For some experiments, cell lines were transduced with firefly luciferase/eGFP and then sorted to obtain a >99% positive population.

The luciferase positive K-562 cell line was also transduced with truncated CD19 or truncated CD123 to obtain cell lines expressing neither of them, only CD19 or only CD123. MOLM-14 and K562 were used as controls as indicated in the relevant figures. The cell lines were maintained in culture with RPMI media 1640 (Gibco, 11875-085, LifeTechnologies, Grand Island, N.Y.) supplemented with 10% fetal bovine serum (FBS, Gemini, 100-106, West Sacramento, Calif.), and 50 UI/ml penicillin/streptomycin (Gibco, LifeTechnologies, 15070-063). De-identified primary human ALL bone marrow (BM) and peripheral blood (PB) specimens were obtained from the clinical practices of University of Pennsylvania/Children's Hospital of Philadelphia under an Institutional Review Board (IRB)-protocol, purchased from the Stem Cells and Xenograft Core of the University of Pennsylvania or from research samples of the current CTL019 clinical trials (Translation and Correlative Study Laboratory, at the University of Pennsylvania). For all functional studies, primary cells were thawed at least 12 hours before experiment and rested at 37° C.

In vivo expansion of primary B-ALL blasts. Methods disclosed in D. M. Barrett, A. E. Seif, C. Carpenito, D. T. Teachey, J. D. Fish, C. H. June, S. A. Grupp, G. S. Reid, Noninvasive bioluminescent imaging of primary patient acute lymphoblastic leukemia: a strategy for preclinical modeling. Blood 118, e112-117 (2011).

Fluorescence in situ hybridization (FISH) and immunohistochemistry. The FISH analysis and immunohistochemistry were performed according to the standard method and as described. (M. A. Belaud-Rotureau, M. Parrens, P. Dubus, J. C. Garroste, A. de Mascarel, J. P. Merlio, A comparative analysis of FISH, RT-PCR, PCR, and immunohistochemistry for the diagnosis of mantle cell lymphomas. *Modern pathology: an official journal of the United States and Canadian Academy of Pathology, Inc* 15, 517-525 (2002)). The FISH analysis was performed according to the standard method. In brief, harvested ALL cells were suspended in fixative (acetic acid and methanol), deposited on the slides, and left to dry. The dual color gene fusion probe BCR/ABL (Abbott Molecular), was applied in the hybridization buffer solution. The slides were cover-slipped, sealed, and left inside the HYBrite chamber at 37 C for 6 hr. After removal of the sealant and the coverslip, the slides were washed twice, blotted, dried, and counterstained with DAPI. The slides were examined under fluorescent microscope, with a minimum of 200 nuclei evaluated in each specimen.

Generation of CAR constructs and CAR T cells. The murine anti-CD19 chimeric-antigen receptor (CD8 hinge, 4-1BB co-stimulatory domain and CD3 zeta signaling domain) was generated as previously described. (Milone, et al., *Molecular therapy: the journal of the American Society of Gene Therapy* 17, 1453-1464 (2009) and Imai, et al., *Leukemia* 18, 676-684 (2004)). This is the same construct currently used in the CTL019 clinical trials at the University of Pennsylvania. For CAR123 scFv anti-CD123 (1172 construct (SEQ ID NO: 707, and as described in PCT/US2014/017328) was used and the same backbone construct of CAR19. Production of CAR-expressing T cells was performed as previously described. (Gill, et al., *Blood* 123, 2343-2354 (2014)). Normal donor CD4 and CD8 T cells or PB mononuclear cells (PBMC) were obtained from the Human Immunology Core of the University of Pennsylvania. T cells were plated at $1\times10^6$/ml with a CD4:CD8 ratio of 1:1 and expanded in X-vivo 15 media (Lonza, 04-418Q), supplemented with human AB serum 5% (Gemini, 100-512), penicillin/streptomycin (Gibco, 15070063) and Glutamax (Gibco, 35050061) using anti-CD3/CD28 Dynabeads (Life Technologies, 11161D) added on the day 1 of culture and removed on day 6. T cells were transduced with lentivirus on day 2. T cells were expanded in culture for 8-15 days and harvested when the median cell volume was below 300 fl. T cells were then cryopreserved in FBS with 10% DMSO for future experiments. Prior to all experiments, T cells were thawed and rested overnight at 37° C.

Multiparametric flow cytometry. Flow cytometry was performed as previously described (Kenderian, et al., *Leukemia*, (2015)). Anti-human antibodies were purchased from Biolegend, eBioscience, or Becton Dickinson. Cells were isolated from in vitro culture or from animals, washed once in PBS supplemented with 2% fetal calf serum, and stained for 15 minutes at room temperature. For cell number quantitation, Countbright (Invitrogen) beads were used according to the manufacturer's instructions. In all analyses, the population of interest was gated based on forward vs. side scatter characteristics followed by singlet gating, and live cells were gated using Live Dead Fixable Aqua (Invitrogen). Time gating was included for quality control. Surface expression of CAR19 was detected as previously described, using an anti-idiotype antibody. Detection of CAR123 was performed using goat-anti-mouse antibody (Jackson Laboratories) or CD123-Fc/His (Sino Biologicals) and anti-His-APC (R&D) or PE (AbCam). Flow cytometry was performed on a four-laser Fortessa-LSR II cytometer (Becton-Dickinson) and analyzed with FlowJo X 10.0.7r2 (Tree Star).

In vitro T-cell effector function assays. Degranulation, CFSE proliferation, cytotoxicity assays and cytokine measurements were performed as previously described. (Gill, et al., *Blood* 123, 2343-2354 (2014) and Kalos, et al., *Science translational medicine* 3, 95ra73 (2011)).

Degranulation assay. Briefly, T cells were incubated with target cells at a 1:5 ratio in T cell media. Anti-CD107a-PECY7 (Biolegend), anti-CD28 (BD Biosciences), anti-CD49d (BD Biosciences) antibodies and monensin (BD Biosciences) were added to the co-culture. After 4 hours, cells were harvested and stained for CAR expression, CD3, CD8 and Live Dead aqua staining (Invitrogen). Cells were fixed and permeabilized (Invitrogen Fix/Perm buffers) and intracellular staining was then performed to detect multiple cytokines (IFN, TNFα, IL-2, GM-CSF, MIP1β).

Proliferation assay. T cells were washed and resuspended at 1×107/ml in 100 ul of PBS and stained with 100 ul of CFSE 2.5 uM (Invitrogen) for 5 minutes at 37° C. The reaction was then quenched with cold media, and cells were washed three times. Targets were irradiated at a dose of 100 Gy. T cells were incubated at a 1:1 ratio with irradiated target cells for 120 hours, adding media at 24 hours. Cells were then harvested, stained for CD3, CAR and Live Dead aqua (Invitrogen), and Countbright beads (Invitrogen) were added prior to flow cytometric analysis for absolute quantification.

Cytotoxicity assays. Luciferase/eGFP+ cell lines were used for cytotoxicity assay as previously described. In brief, targets were incubated at the indicated ratios with effector T cells for 24 hours. Killing was calculated by bioluminescence imaging on a Xenogen IVIS-200 Spectrum camera.

Cytokine measurements. Effector and target cells were co-incubated at a 1:1 ratio in T cell media for 24. Supernatant was harvested and analyzed by 30-plex Luminex array (Luminex Corp, FLEXMAP 3D) according to the manufacturer's protocol (Invitrogen).

Animal experiments. In vivo experiments were performed as previously described. (Kenderian, et al., *Leukemia*, (2015)). Schemas of the utilized xenograft models are discussed in detailed in the relevant figures, result. NOD-SCID-γ chain−/− (NSG) originally obtained from Jackson Laboratories were purchased from the Stem Cell and Xenograft Core of the University of Pennsylvania. All experiments were performed according a protocol (#803230) approved by the Institutional Animal Care and Use Committee (IACUC) that adheres to the NIH Guide for the Care and Use of Laboratory Animals. Cells (leukemia cell lines or T cells) were injected in 200 ul of PBS at the indicated concentration into the tail veins of mice. Bioluminescent imaging was performed using a Xenogen IVIS-200 Spectrum camera and analyzed with LivingImage software v. 4.3.1 (Caliper LifeSciencies). Animals were euthanized at the end of the experiment or when they met pre-specified endpoints according to the IACUC protocols.

Multiphoton microscopy. Mice were anaesthetized and maintained at core temperature of 37° C. Bone marrow was imaged after removing the scalp and immobilizing the skull. Imaging was performed using a Leica SP5 2-photon microscope system (Leica Microsystems) equipped with a picosecond laser (Coherent). Each imaging acquisition lasted 20 min followed by an assessment of mouse sedation. CellTrace Violet, GFP, and CellTrace Orange (or TRITC) were excited using laser light of 850 nm. Images were obtained using a 20× water-dipping lens. The resulting images were analyzed with Volocity software (PerkinElmer).

Statistical analysis. All statistics were performed as indicated using GraphPad Prism 6 for Windows, version 6.04 (La Jolla, Calif.). Student's t-test was used to compare two groups; in analysis where multiple groups were compared, one-way analysis of variance (ANOVA) was performed with Holm-Sida correction for multiple comparisons. When multiple groups at multiple time points/ratios were compared, the Student's t-test or ANOVA for each time points/ratios was used. Survival curves were compared using the log-rank test. In the figures asterisks are used to represent p-values (*=<0.05, =<0.01, *=<0.001, ****=<0.0001) and "ns" means "not significant" (p>0.05). Further details of the statistics for each experiment are listed in figure legends.

Results

Figure 31A:
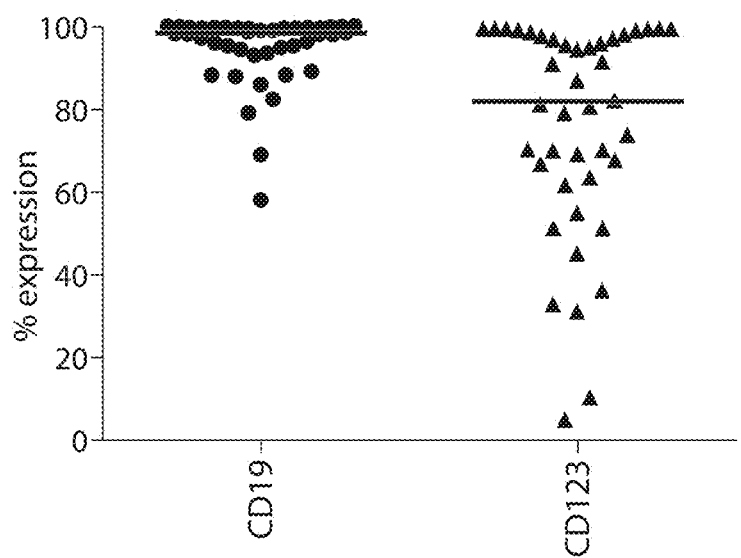
Figure 31B:
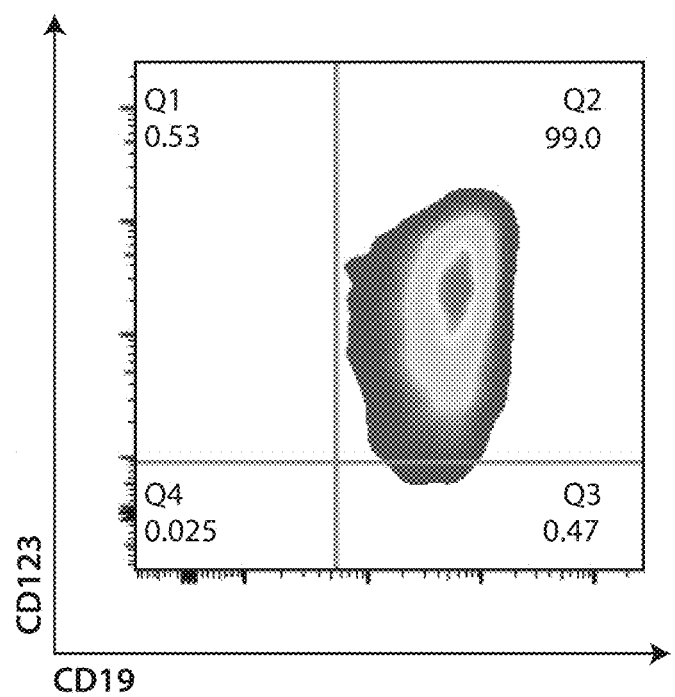
Figure 31C:
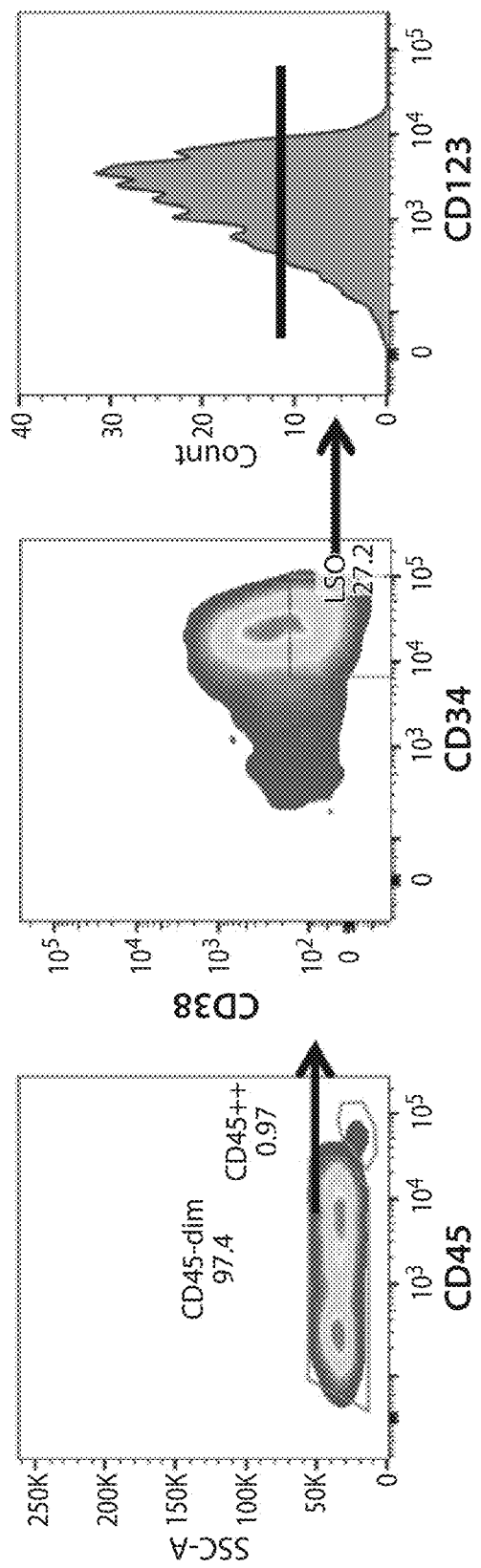
Figure 38A:
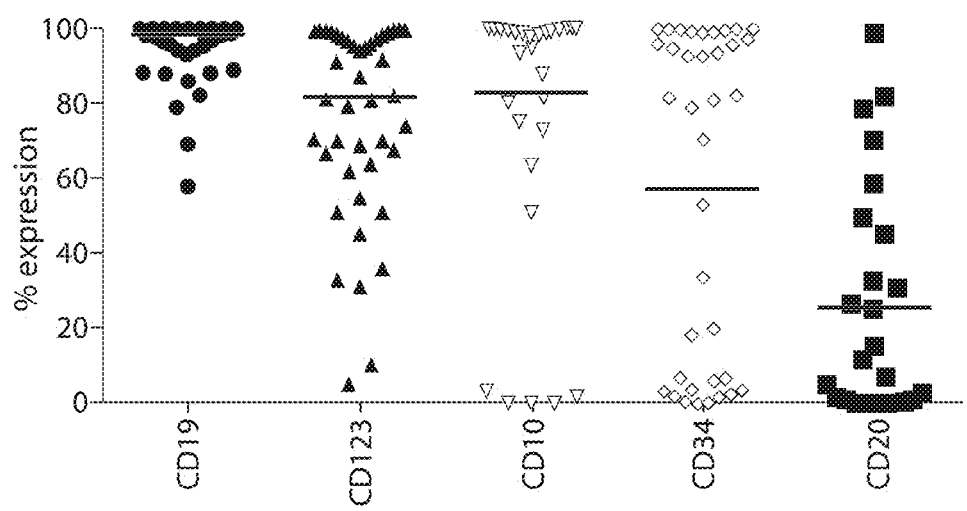

CD123 is Expressed in B-ALL, in the Leukemia Stem Cells and in CD19-Negative Relapses In order to evaluate the expression of CD123 in B-cell acute lymphoblastic leukemia, 42 samples from adult and pediatric ALL patients were analyzed, including 14 subjects enrolled in our current CTL019 clinical trials. As shown in FIGS. 31A, 31B and 38A, CD123 is highly and homogeneously expressed on the surface of most ALL blasts, representing an ideal candidate for targeted therapy. Moreover, CD123 is also found to be expressed in the putative leukemia stem cells (LSC), identified as CD34+ CD38− (FIG. 31C). Small subsets of CD19-negative blasts can be identified in some B-ALL patients and these cells could contribute to antigen-loss relapses, if they contained cells with a malignant phenotype. In order to evaluate the presence of disease in CD19-negative subsets, CD19− CD123+ cells from a Philadelphia chromosome positive B-ALL bulk population were sorted (CD45dim, gating strategy shown FIG. 38B). It was found that these cells were clonal for the BCR-ABL translocation, albeit at a lower frequency than the CD19+ blasts (FIG. 31D). This finding indicates that targeting CD19 alone could, in some cases, lead to a subclonal relapse derived from CD19−CD123+ cells. Furthermore, this finding suggests that targeting CD123 could lead to deeper responses through the elimination of the LSC and possibly CD19-neg leukemia clones.

Figure 31F:
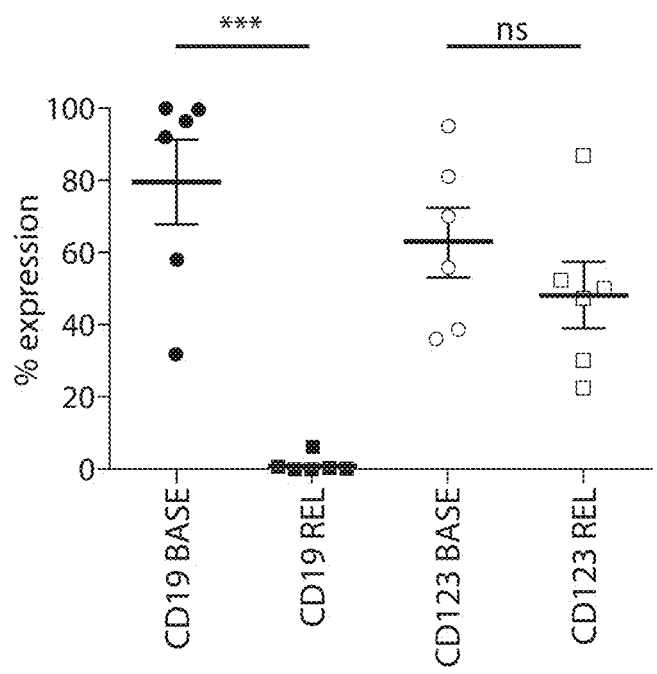

Finally the expression of CD123 was also evaluated in the samples of B-ALL patients relapsing after CTL019 with loss of CD19. Importantly, in contrast to the complete loss of CD19, the majority of patients maintained CD123 expression at relapse (FIGS. 31E, 31F and 38C). These findings indicate that CD123 represents an ideal marker to target CD19-neg ALL blasts occurring after CART19 or blinatumomab.

Anti-CD123 Chimeric Antigen Receptor T Cells are Active Against Human B-ALL In Vitro and In Vivo Anti-CD123 chimeric antigen receptor T cells (CART123) were generated (37) that were lentivirally transduced and expanded with anti-CD3/CD28 magnetic beads. The in vitro and in vivo activity of CART123 against B-acute lymphoblastic leukemia were evaluated as described herein.

Figure 32A:
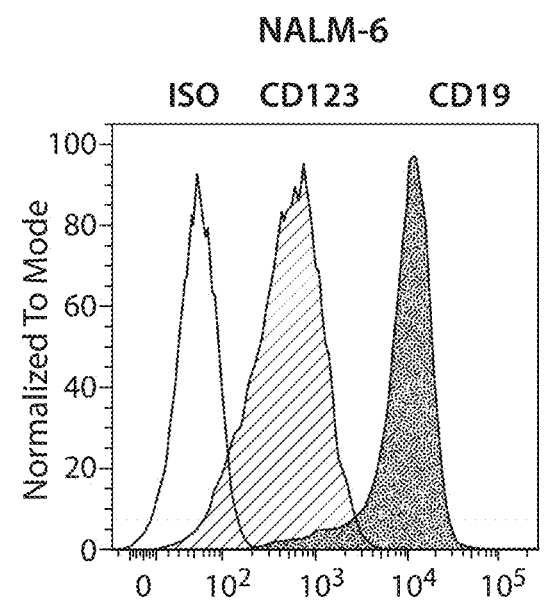
FIGS. 32A, 32B, 32C, 32D, 32E, and 32F show results from various in vitro assays using T cells expressing a CD19 CAR (CAR19) or a CD123 CAR (CAR123).
Figure 32B:
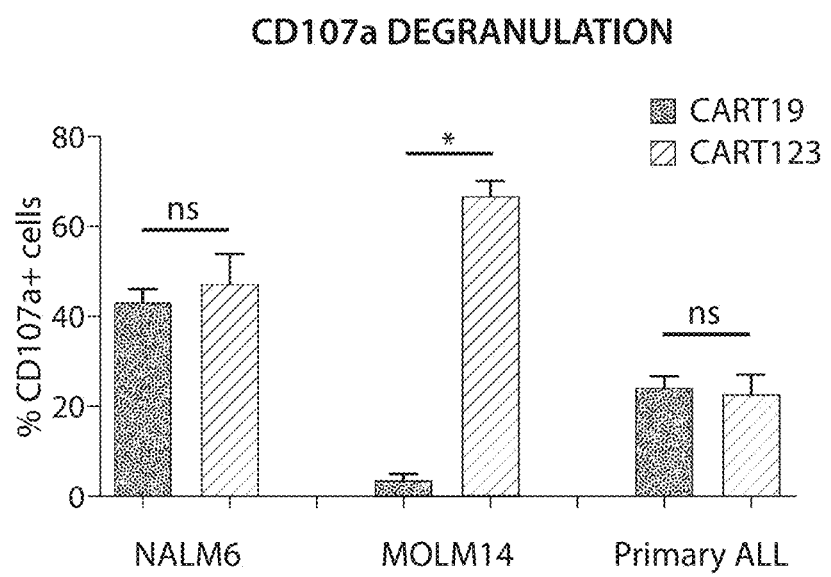
Figure 32C:
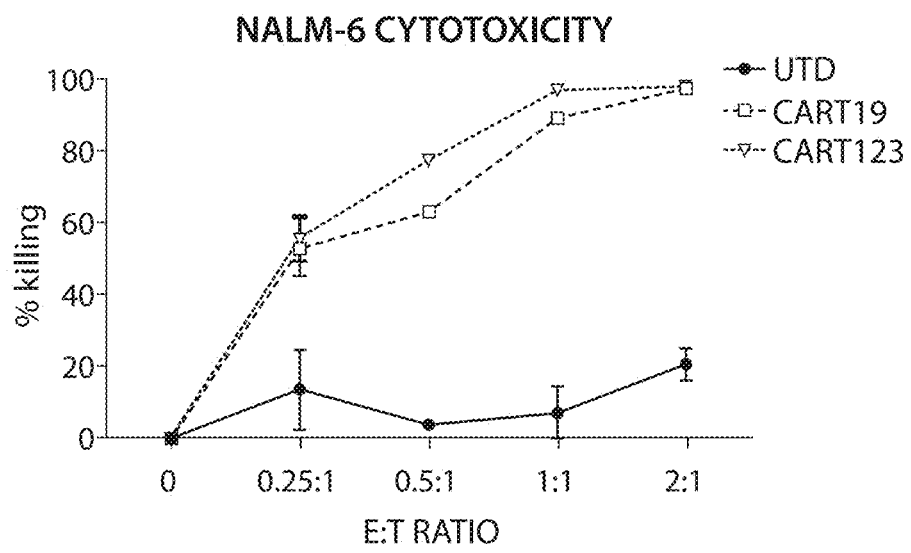
Figure 32D:
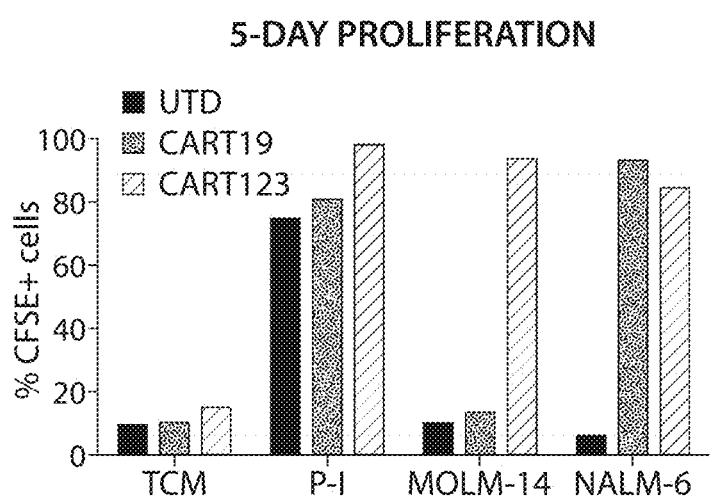
Figure 32E:
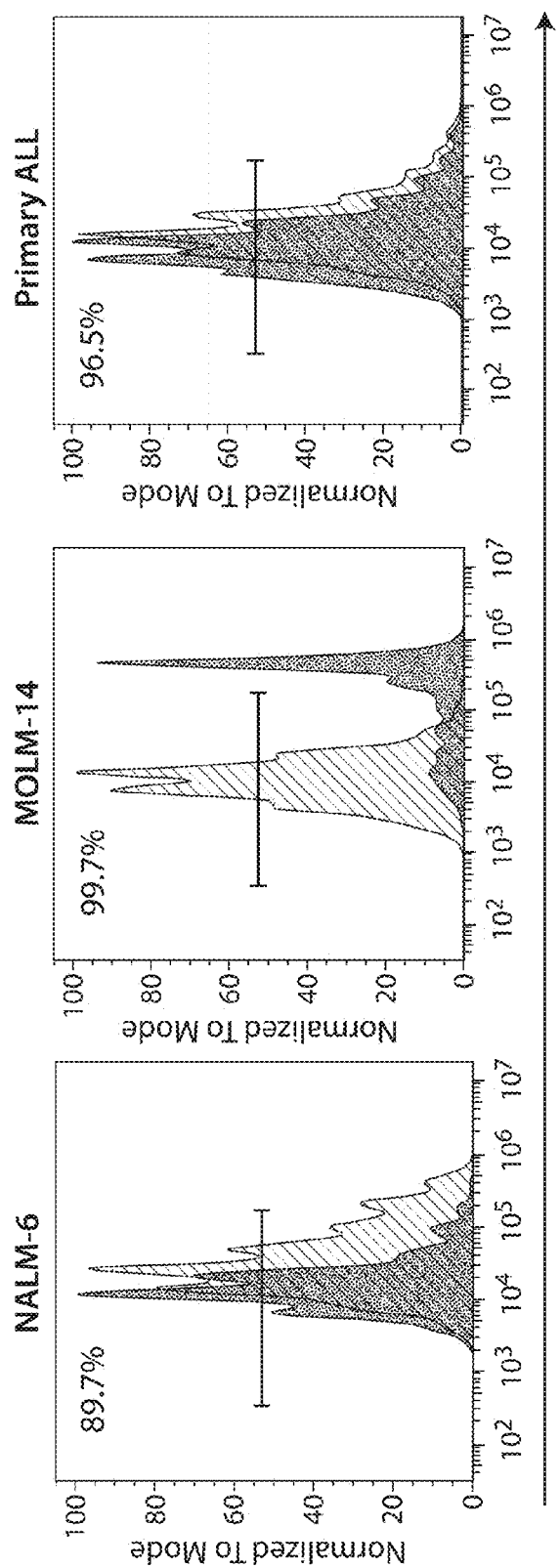
Figure 32F:
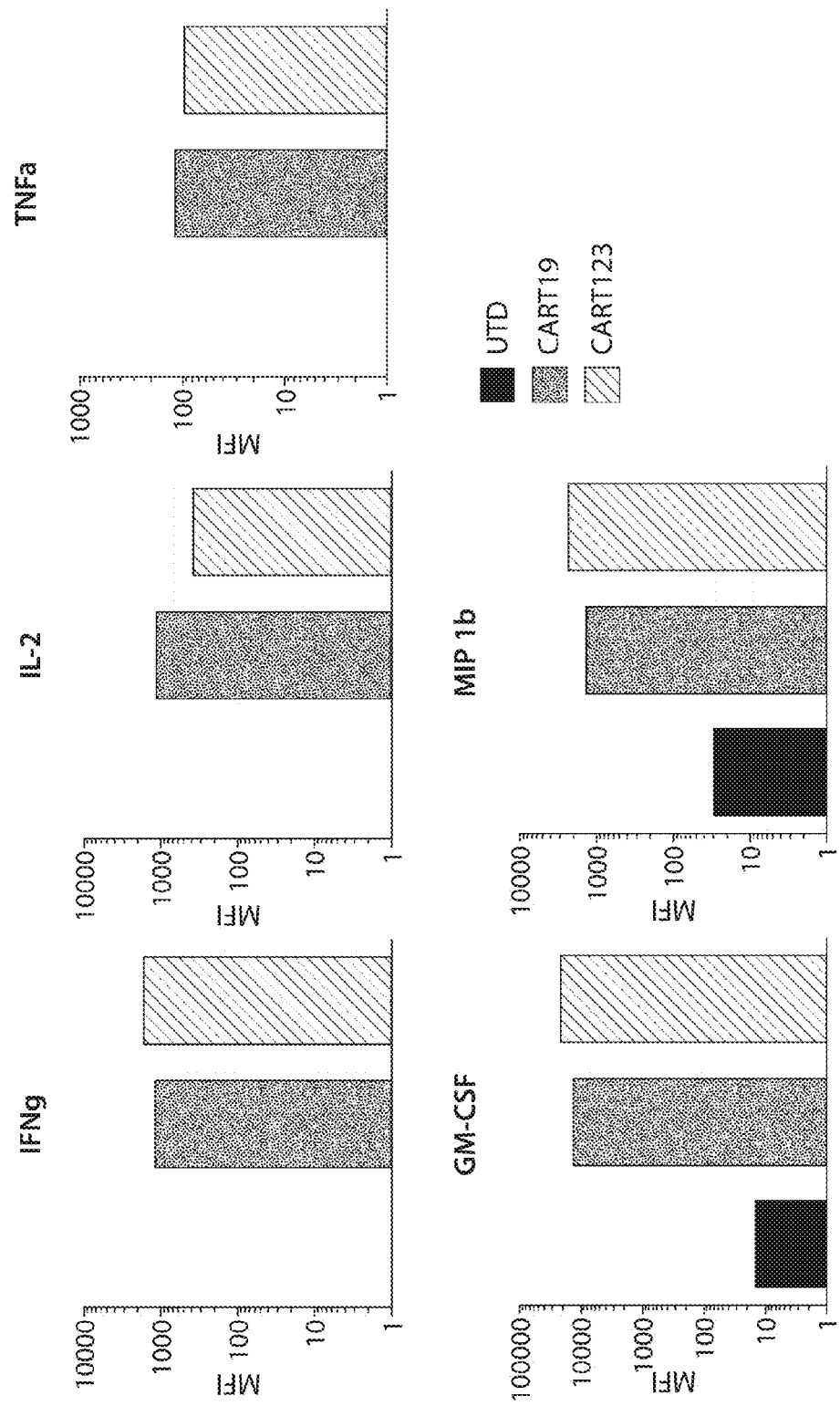
Figure 39A:
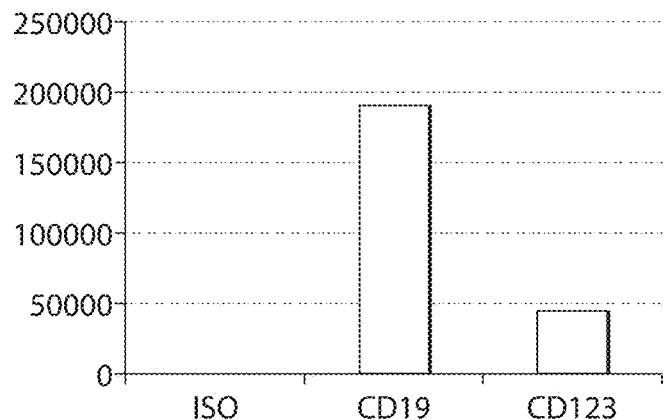
FIGS. 39A, 39B, 39C, and 39D show anti-leukemia activity of CART123.

The B-ALL cell line NALM-6 that is CD19++ and CD123+ (FIGS. 32A and 39A) and primary B-ALL samples were used. A head-to-head in vitro comparison between CART123 and CART19 revealed similar rates of CD107a degranulation when T cells were co-cultured with NALM-6 or primary ALL (FIG. 32B). CART123 were also able to kill NALM-6 cells with similar efficacy as CART19 in a dose-dependent manner (FIG. 32C). At more long-term experiments, CART123 proliferated (FIGS. 32D and 32E) and produced multiple cytokines (FIG. 32F) when co-cultured with NALM-6 or primary ALL for 3-5 days. These results indicate that CART123 exhibit equivalent potency to CART-19 against multiple B-ALL targets.

Figure 33A:
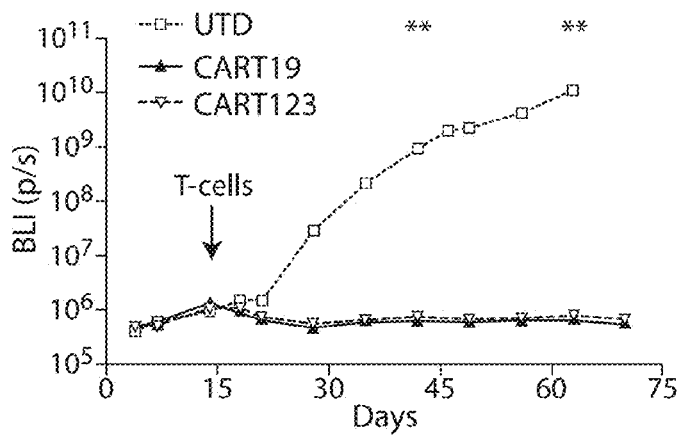
FIGS. 33A, 33B, and 33C show that CART cells expressing CD19 CAR (CAR19) or CD123 CAR (CAR123) had an anti-tumor effect in an in vivo mouse model.
Figure 33B:
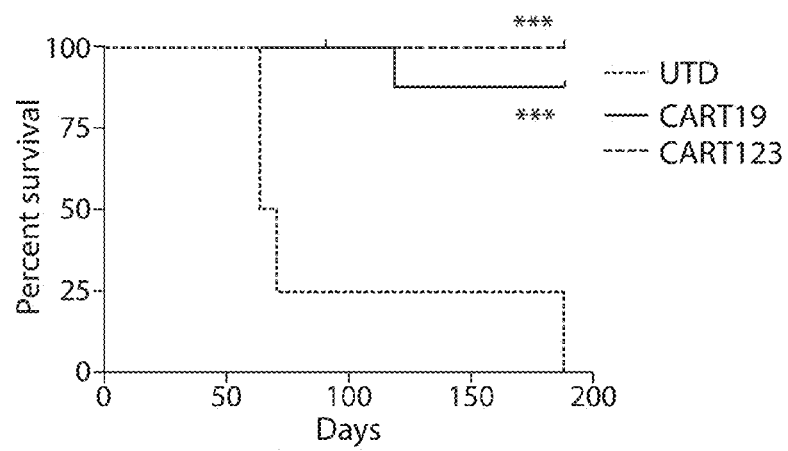
Figure 33C:
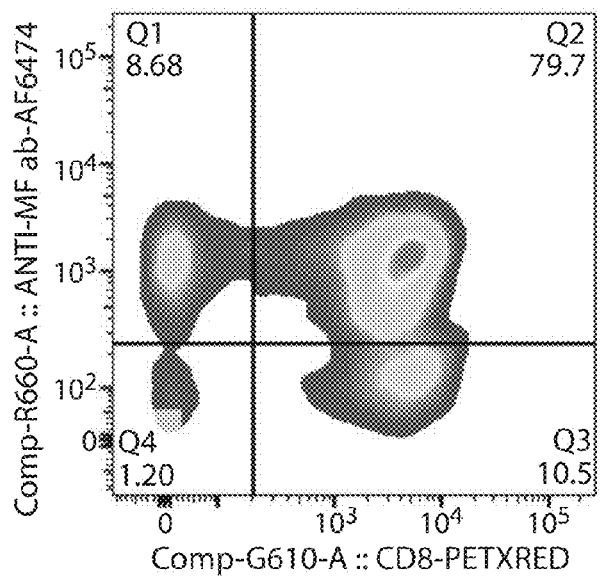
Figure 39B:
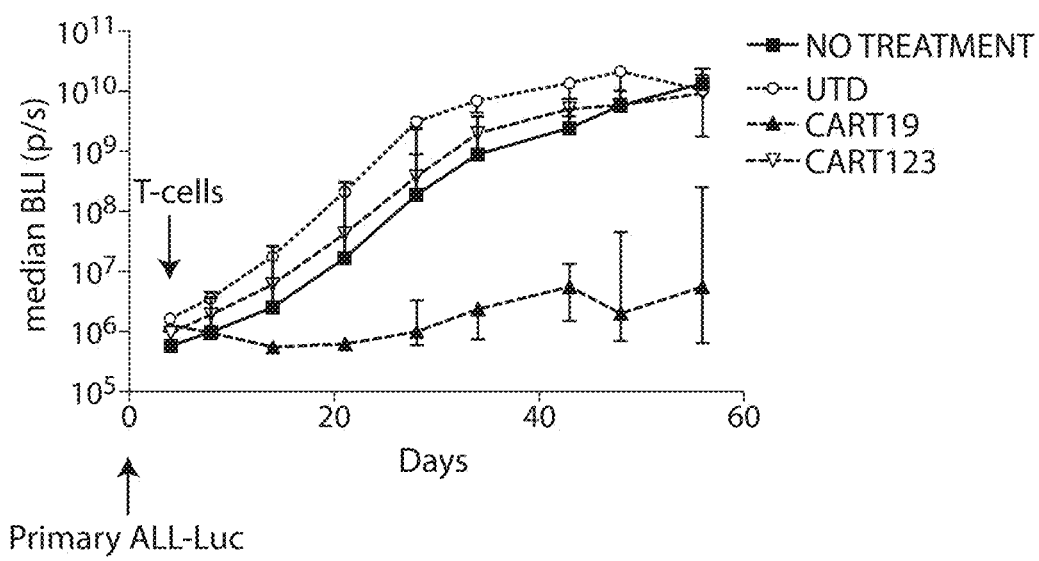
Figure 39C:
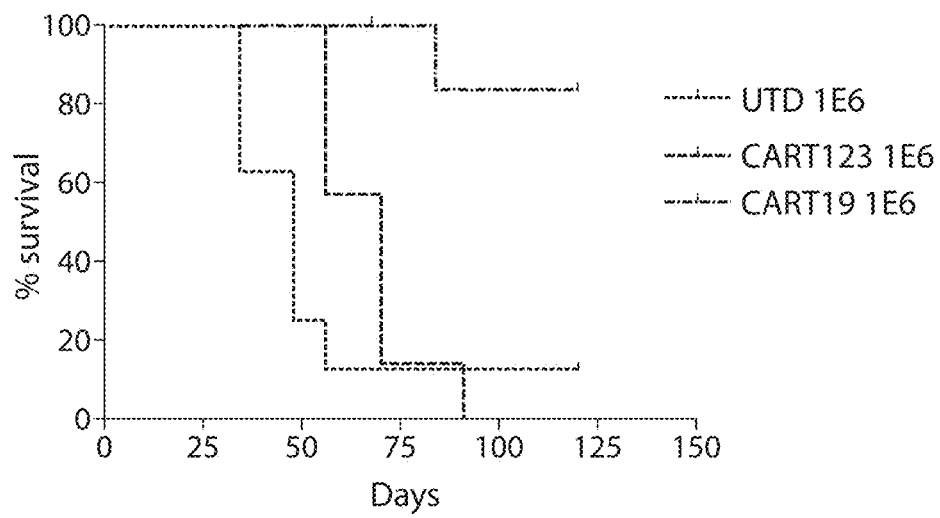

In order to confirm these data in an in vivo model, a primary ALL model was utilized. In this model, primary blasts obtained from B-ALL patients were passaged in NOD-SCID-γ chain knock-out (NSG) mice and transduced with a reporter construct containing eGFP and click beetle luciferase (GFP/Luc). NSG mice were injected with GFP/Luc+ primary ALL blasts i.v. (JH331, CD19+, CD123+, add phenotype) and after engraftment, mice were randomized to receive CART19, CART123 or control untransduced T cells (UTD). Mice treated with control T cells succumbed quickly to disease, while mice treated with either CART19 or CART123 showed tumor eradication and long term survival (FIGS. 33A and 33B). CAR123 T cells significantly expanded in the peripheral blood (PB) of the mice compared to control T cells and expressed high levels of CAR123 (FIG. 33C). The anti-leukemia activity of CART123 was specific and based on the recognition of CD123 in the surface of the blasts as when we engrafted mice with a CD123−CD19+ leukemia (AV576), only CART19 show anti-leukemia activity, while CART123 had no effect as compared to controls UTD (FIGS. 39B and 39C).

Figure 39D:
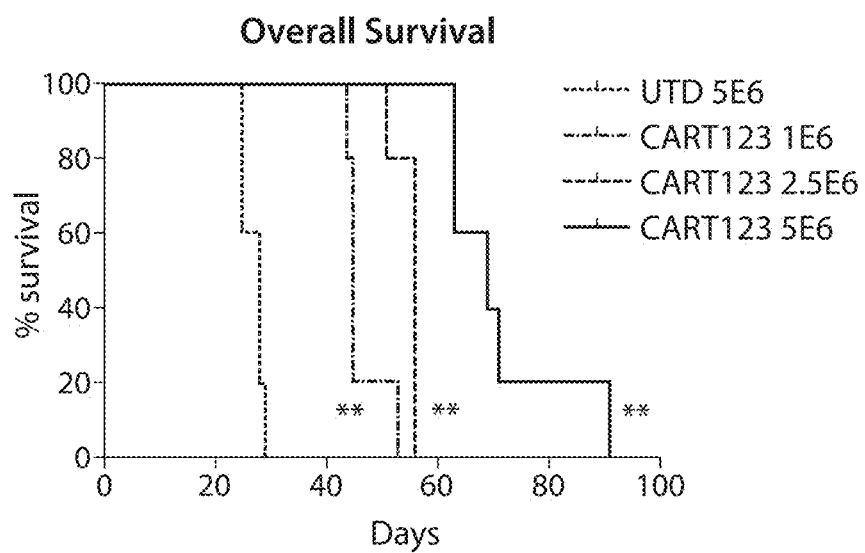

In order to detect a possible correlation of CART123 dose and anti-tumor activity, an in vivo model of high leukemia burden bearing mice (using the NALM-6 cell line) was developed. In this model standard doses of CART123 (2 million CAR+ cells) are not able to clear the tumor. These mice were injected with different doses of CART123 (1.25, 2 and 5 million CAR+ cells) and observed a dose-related anti-leukemia activity (FIG. 39D).

Figure 34A:
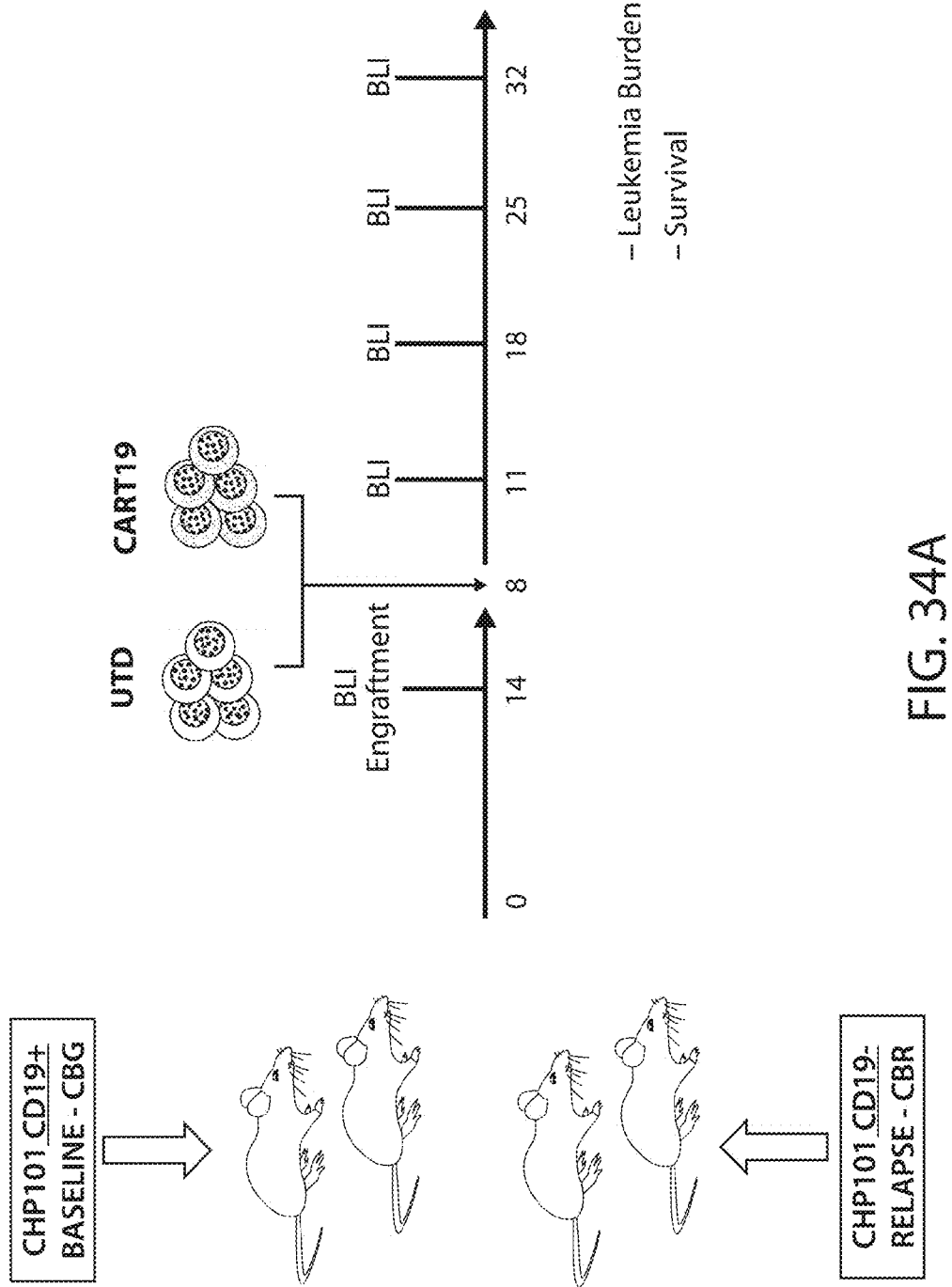
FIGS. 34A, 34B, 34C, 34D, 34E, and 34F show that CART123 is active in an in vivo mouse model of antigen-loss relapse.
Figure 34B:
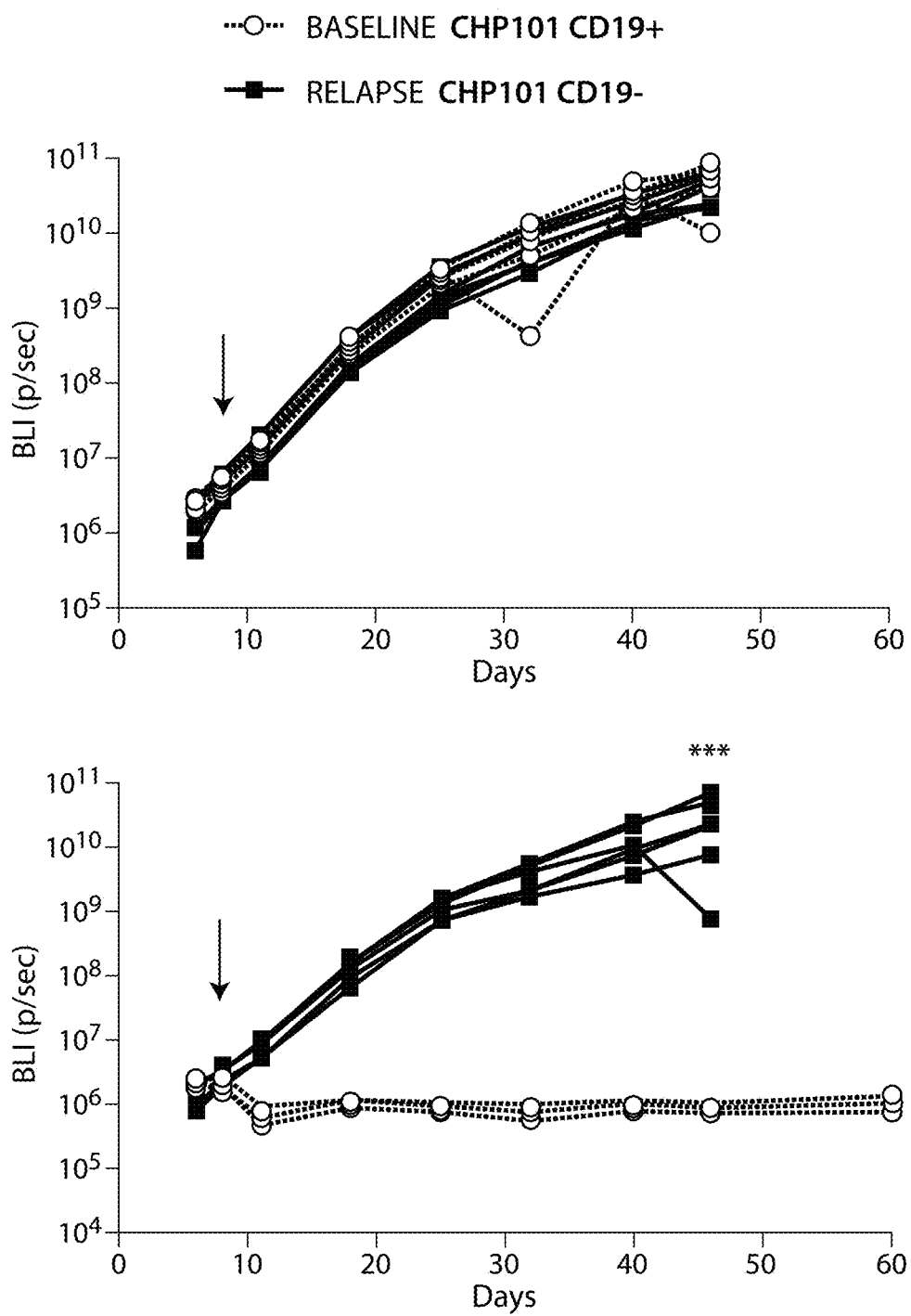
Figure 34C:
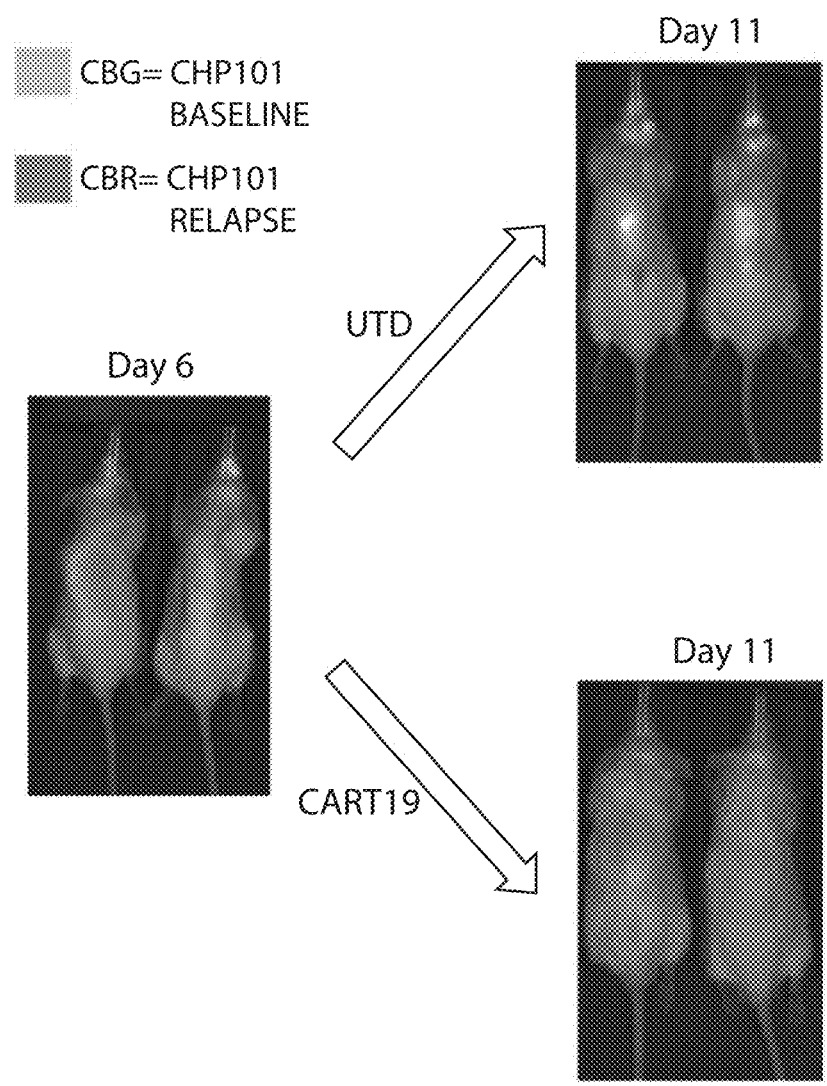
Figure 40A:
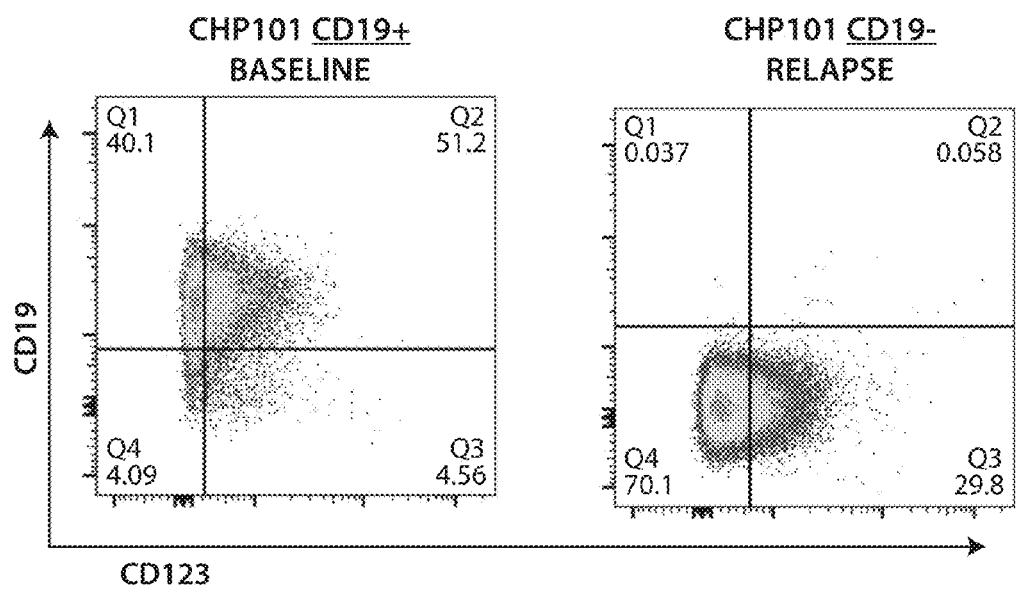
FIGS. 40A and 40B show the characterization of the in vivo model of antigen-loss relapse.
Figure 40B:
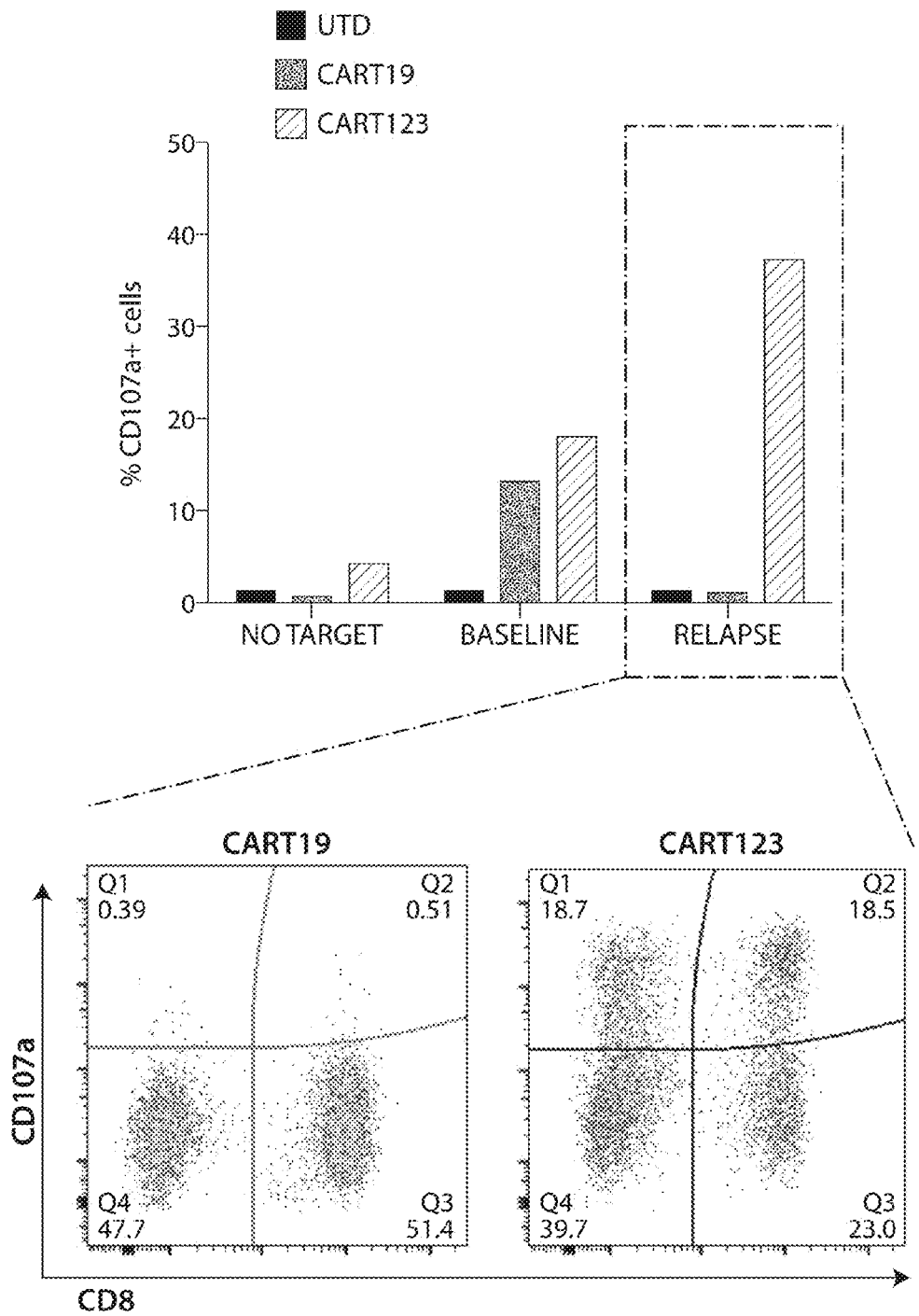

CART123 but not CART19 are Highly Active in a Novel Preclinical Model of Antigen-loss Relapse In order to test new strategies to target CD19-negative relapses a novel in vivo model of antigen-loss relapse was developed. B cell blasts obtained from a patient (CHP101) enrolled in one of our CTL019 clinical trials were collected at baseline (before CTL019 therapy), when the disease was CD19++ and CD123+, and at relapse after CTL019 when the patient developed a CD19-negative disease (CD123 still expressed, FIG. 40A). Blasts were then expanded in NSG mice and transduced with click-beetle green luciferase (CBG) for baseline disease (CD19+) or click-beetle red luciferase (CBR) for relapse (CD19−) (see Methods section). Importantly, during in vivo expansion, the blasts retained markers of B cell identity other than CD19 (data not shown). In a first experiment NSG mice were engrafted with either the baseline disease CD19+ (CBG, green) or the CD19-neg (CBR, red) leukemia. Both groups were randomized to receive CART19 or control T cells (UTD) (FIG. 34A). As shown in FIG. 34B, in both groups mice treated with UTD showed rapid progression of both the baseline and relapse disease, independently by the expression of CD19. Conversely, in the group of mice treated with CART19, only mice engrafted with the baseline disease (CD19-positive) responded to CART19 treatment while mice engrafted with the relapsed disease (CD19-negative) showed refractoriness as expected. This was also reproduced in vitro in a CD107a degranulation assay (FIG. 40B). In order to simulate in vivo the presence of different clones expressing CD19 or lacking it, NSG mice were engrafted with a 1:1 mixture of baseline and relapse disease; at day 8 mice were randomized to receive CART19 or control T cells. Tumor burden was monitored with bioluminescence imaging that could discriminate between CD19+(CBG, green)/CD19− (CBR, red) leukemia relative growth in vivo. As shown in FIG. 43C, in mice receiving UTD both CD19+ (green) and CD19− (red) leukemia present at day 6 was similarly increased at day 11, while in mice treated with CART19 the baseline disease (green) was completely cleared while the relapsed disease (red) showed progression.

Figure 34D:
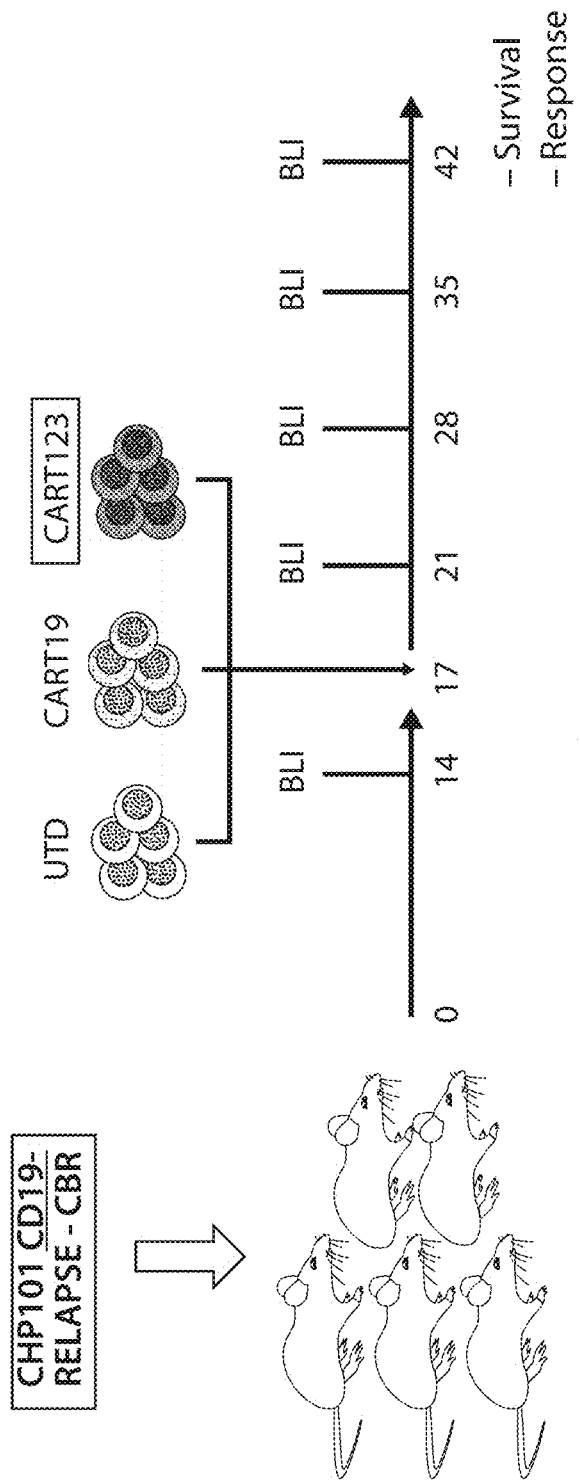
Figure 34E:
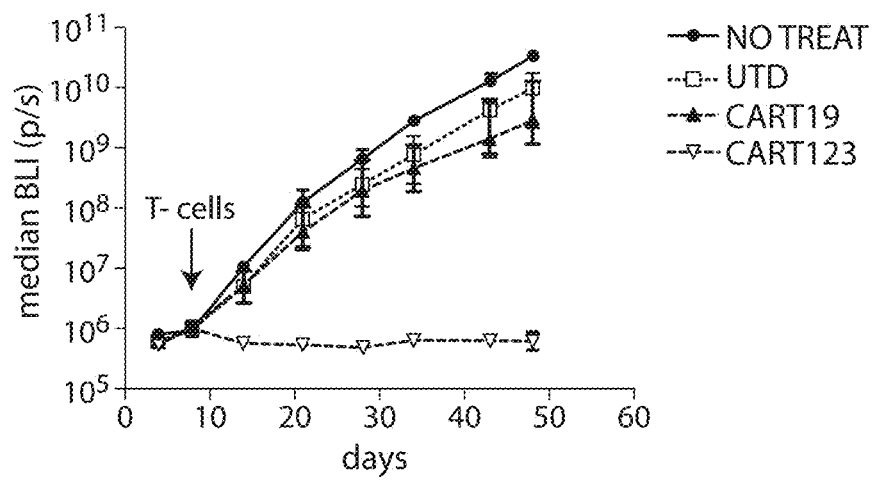
Figure 34F:
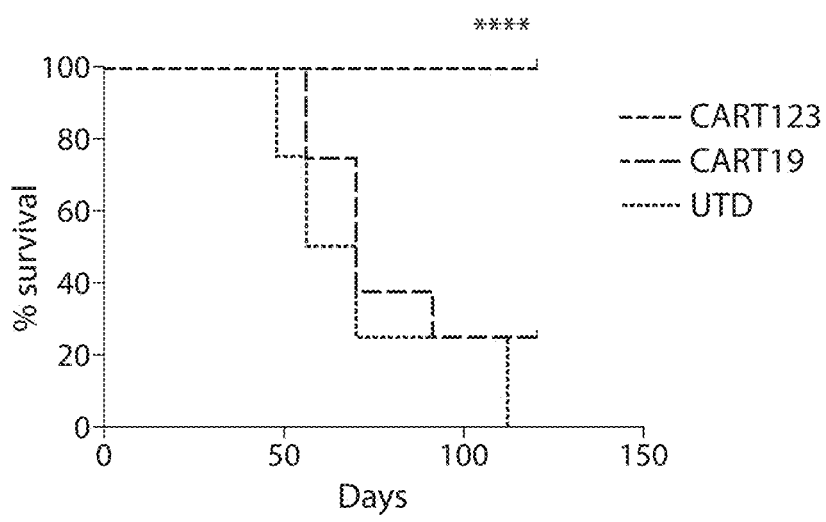

This unique xenograft model of primary CD19-negative B-ALL and CART19 failure was used to evaluate the role of CART123 in the treatment of antigen-loss relapses. Primary CD19-negative blasts (CBR positive) were injected into NSG mice (FIG. 34D) and mice were randomized to receive CART19, CART123 or control T cells. CART19 and control T cells showed complete lack of anti-tumor activity, while CART123 lead to complete eradication of the disease and long term survival in these mice (FIGS. 34E and 34F). Indeed in a pre-clinical model of primary B-ALL refractory to CART19, the novel CART123 are able to eradicate the disease and confer long-term survival.

Figure 35A:
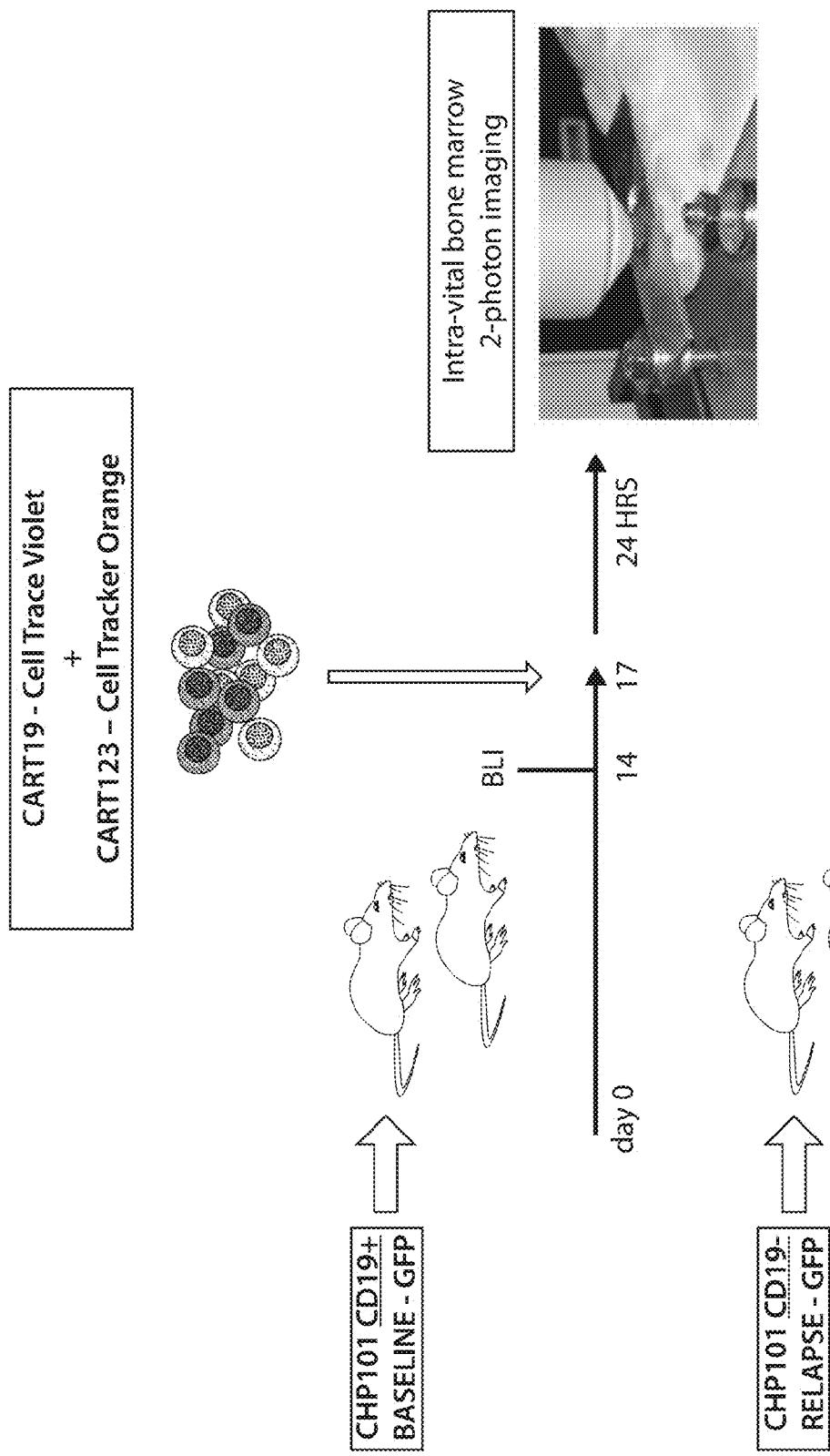
FIGS. 35A, 35B, and 35C show ALL-CART interactions in skull bone marrow of xenograft mice.
Figure 35B:
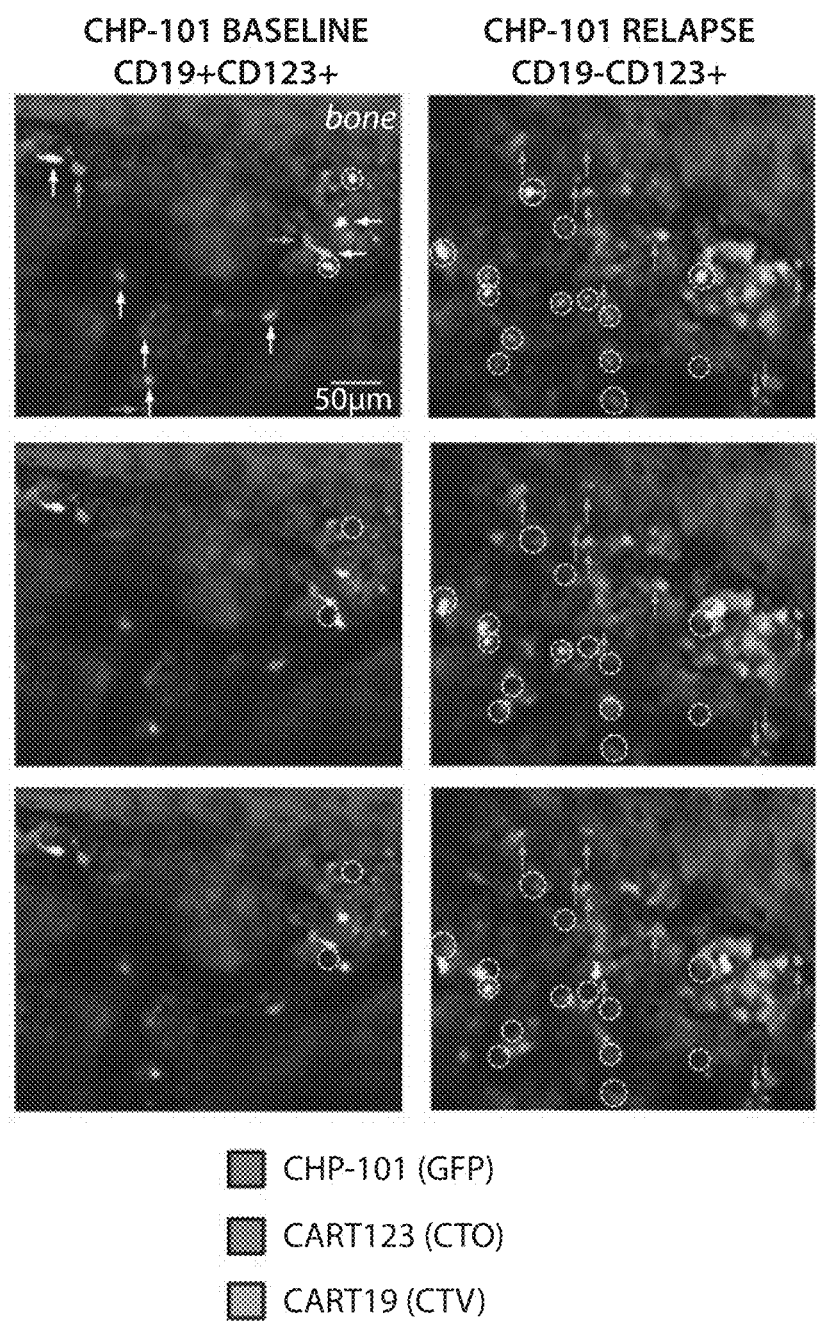
Figure 35C:
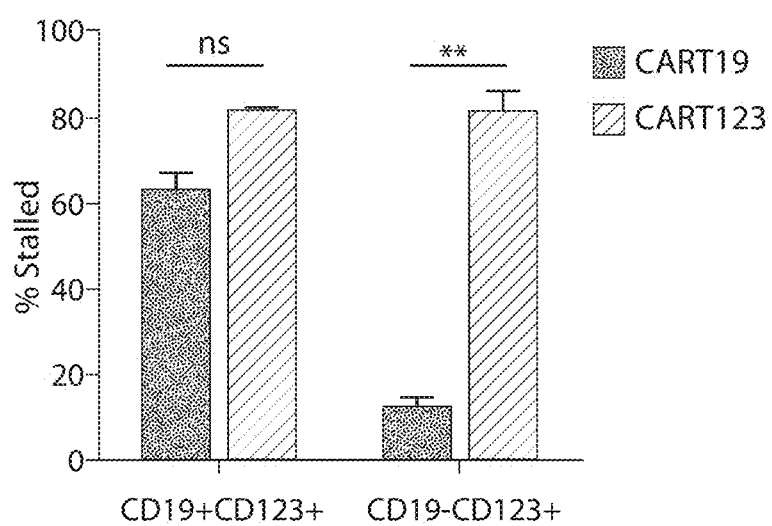

In order to understand the differential behavior of CART19 and CART123 in this in vivo model at a single cell level, a series of experiments was performed by injecting a mixture of differentially labelled CART19 (CellTrace Violet, blue) and CART123 (CellTracker Orange or TRITC, red) to mice bearing CD19-positive primary blasts (GFP) or CD19-negative relapsed blasts (GFP) and tracked their behavior using intravital 2-photon microscopy of calvarial marrow approximately 24 hours after injection (experiment schema, FIG. 35A). These studies showed that CART19 and CART123 trafficked to marrow spaces containing leukemia and that CART cell recognition of cognate antigen correlate with motility arrest. Specifically, in mice engrafted with the baseline CD19+CD123+ leukemia, 62.9%+/−3.8 of CART19 and 81.1%+/−1.2 of CART123 were found to be stalled with a rounded morphology adjacent to blasts, whereas in mice engrafted with the relapsed CD19−CD123+ leukemia, only CART123 cells arrested next to tumor cells (CART123 80.9%+/−5.1 vs CART19 12.4%+/−2.2) (FIGS. 35B and 35C). These findings indicate that in CD19-negative relapsed ALL only CART123 were able to establish productive synapses with the leukemia cells (GFP) and thus reduced their motility, whereas CART19 cells continued sampling and moving in the environment without recognizing the leukemia blasts.

The Combination of CART123 and CART19 is Able to Prevent CD19-Negative Relapses

Figure 36A:
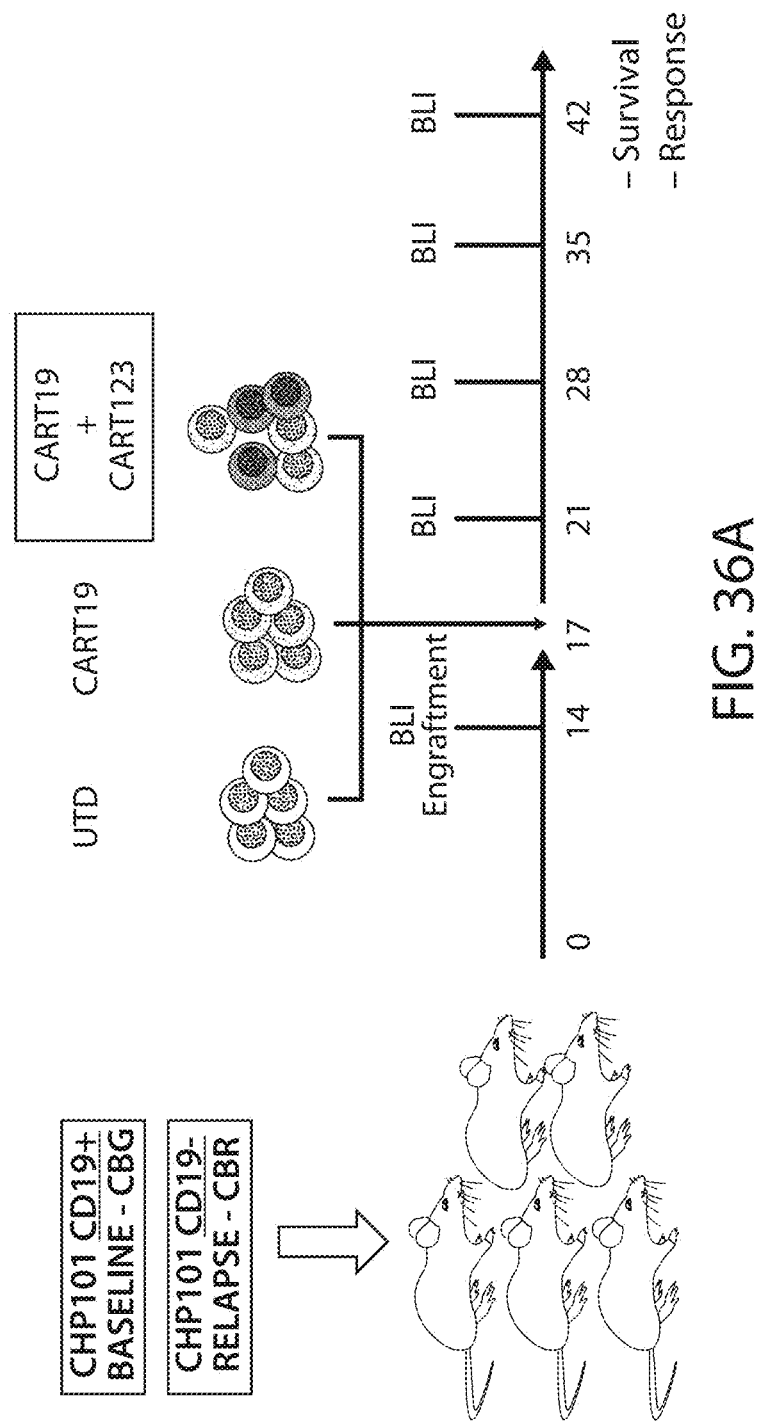
FIGS. 36A, 36B, and 36C show the prevention of CD19-neg relapses using CART19 and CART123.
Figure 36B:
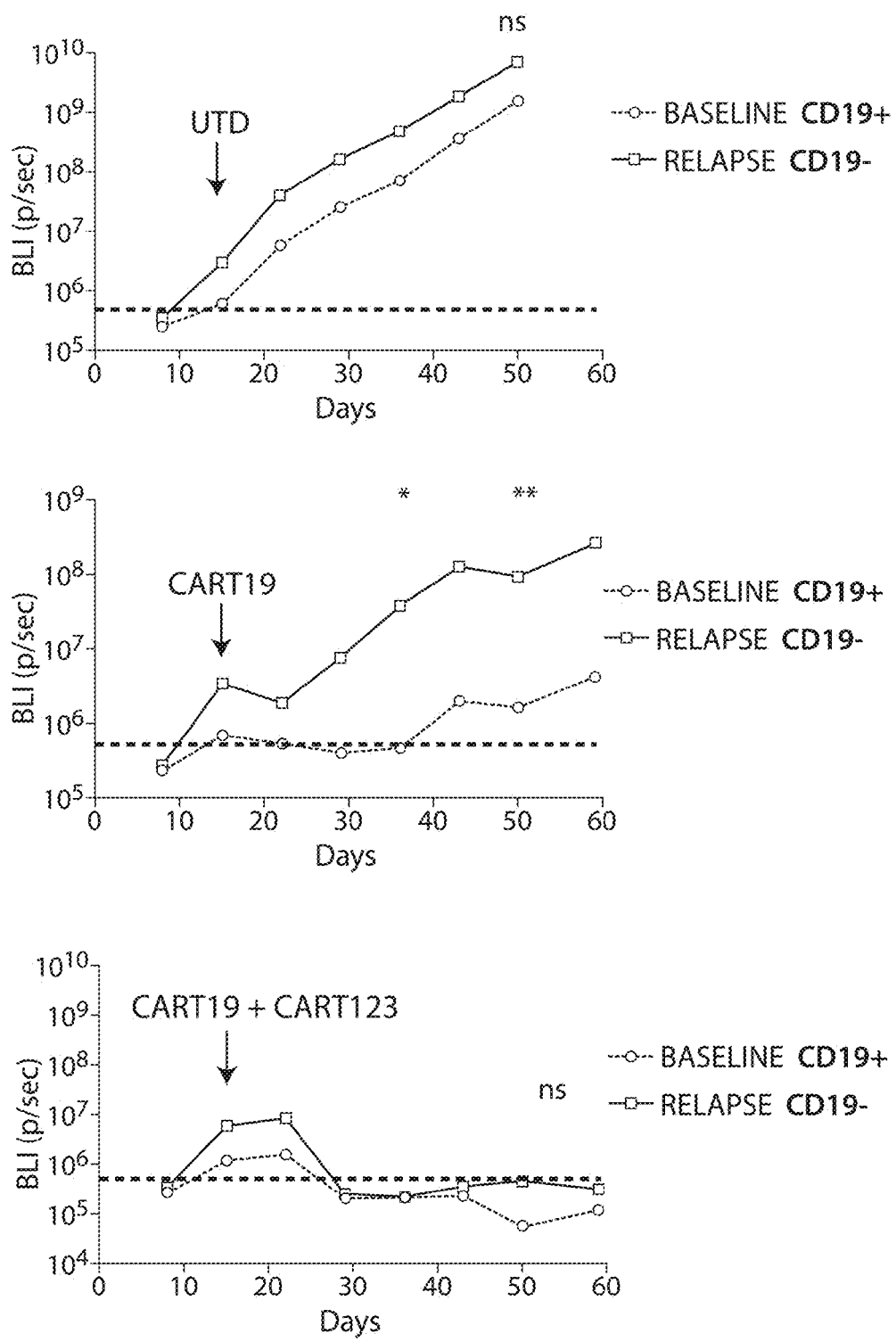
Figure 36C:
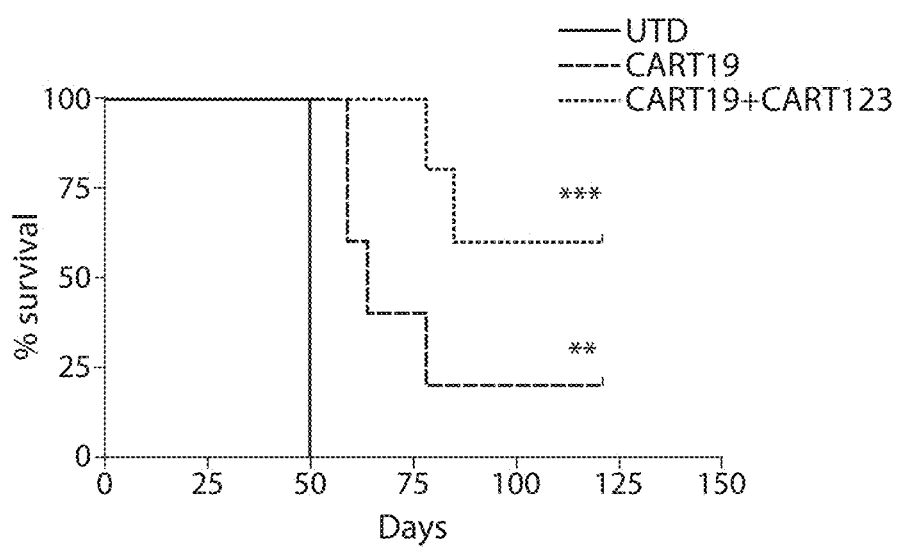

CART123 proved to be effective in the treatment of CD19-negative relapses occurring after CD19-directed therapies in a preclinical model of CART19 resistance. However, a combinatorial approach could treat active CD19-positive disease while simultaneously preventing antigen-loss relapses. In order to test this hypothesis the emerging clinical problem of B-ALL with a potential for CD19-negative escape was modeled by injecting primary CD19− and CD19+ disease together into NSG mice. Mice were then randomized to receive control T cells (UTD), CART19 or the combination of CART19 and CART123, with the same total dose of T cells (FIG. 36A). As shown in FIG. 36B, mice treated with control T cells had progression of both leukemia clones and CART19 showed rapid progression mostly of the CD19-neg disease (red). On the contrary mice treated with the combination of CART123 and CART19 showed clearance of the disease and improved overall survival, as shown in FIG. 36C. Analysis of mice sacrificed at the end of the experiment showed no evidence of residual leukemia in the pooled CAR T cell group. In contrast, mice with progressive disease after CART19 monotherapy retained the expected CD19 negative phenotype (FIG. 36D).

Figure 37A:
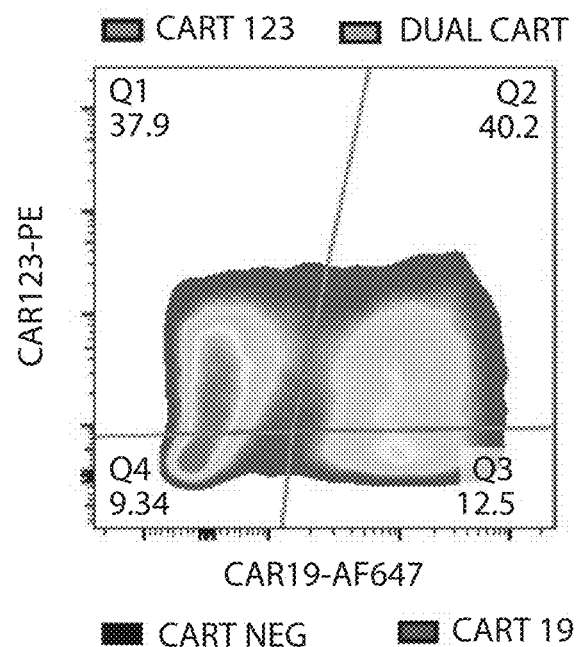
FIGS. 37A and 37B show T cells expressing both CAR19 and CAR123 (FIG. 37A) and the results from a degranulation assay (FIG. 37B).
Figure 37B:
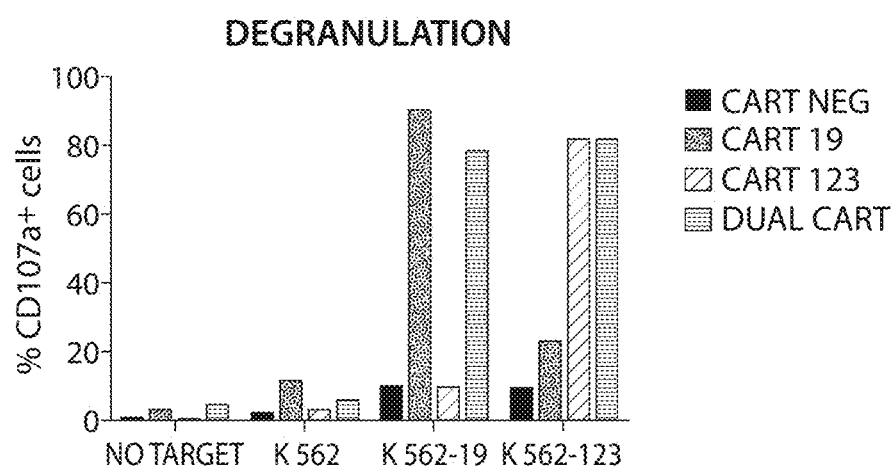

Lastly, T cells were transduced with 2 lentiviruses, one carrying CAR19 and the other CAR123 in order to develop a CART able to be activated by both CD19 and/or CD123. As shown in FIG. 37A, four differently transduced T cell subsets were detected: CAR19 and CAR123 double negative, CAR19 single positive, CAR123 single positive and double positive CAR19/CAR123 T cells. These four subsets were sorted and their functionality and specificity was tested against K562-WT, K562 CD19+ or K562 CD123+. FIG. 37B shows the results of a CD107a degranulation assay where the single positive subsets respond to their specific target while only the double positive population is able to degranulate in the presence of both CD19 and CD123 expressing K562. In addition, dually-stimulated CART cells exhibited more potent cytotoxicity against a double-positive target in comparison with an equivalent number of single-stimulated CART cells, suggesting a potential increment in efficacy by using a CAR that is triggered by two different antigens. (FIG. 37C)

Discussion

CD19 directed immunotherapies are changing the paradigm of treatment of relapsing and refractory acute lymphoblastic leukemia. Patients with a previously dismal outcome now have a realistic potential to achieve a complete response and long-term disease remission. However, as shown under some circumstances for leukemia treated with other forms of potent targeted therapy, leukemia cells are able to develop antigen-loss mutations that lead to resistance and relapse. In the case of CART19, two main patterns of relapses have been observed. Patients with early loss of CART19 through failure of persistence are at risk for relapse of the original clone; indeed, minimal residual disease analyses indicate that between 1-6 months of sustained CART activity may be required to completely eradicate malignancy. In contrast, around 50% of relapses occur despite CART19 persistence and are characterized by the occurrence of aCD19-negative leukemia. The latter observation implicates potent selective pressure by CART19. Notably, CD19-negative relapses have also occurred after blinatumomab therapy although these represent the minority of relapse occurrences after this arguably less potent therapy. (5) There are multiple potential mechanisms for the development of CD19-negative disease. One of these is the selection and relative survival advantage of CD19-negative clones that were present at baseline in very low frequency, and this was initially considered the most likely factor leading to CD19-negative relapses. More recently other mechanisms, such the dysregulation of the splicing of CD19 have also been considered important. Here it is shown for the first time that rare CD19-ve blasts in B-ALL can contain the hallmark cytogenetic abnormalities found in the more common CD19-positive leukemia blasts, confirming this as a potential mechanism of CD19-negative relapse. We confirmed these findings by demonstrating that CD123+ CD19-ve blasts can engraft in immunodeficient mice, indicating that CD123 may be a marker of leukemic stem cells in B-ALL as it is in AML.

The goal of this study was to define novel strategies to treat patients relapsing with antigen loss after CD19-directed therapies. CD123 was highly expressed in the majority of B-ALL, and in particular CD123 remains expressed in those relapsing with CD19-negative disease. It was demonstrated the presence of clonal leukemic cells in the CD19− CD123+ population indicating that targeting CD123 in combination with CART19 can increase the likelihood of eradicating sub-clones that could proliferate due to a selective advantage upon CART19 pressure. CD123 has previously been validated as a marker of the leukemic stem cell in AML. Here it was shown that CD123 to be expressed in the immunophenotypically-defined leukemic stem cell (LSC) in ALL, raising the possibility that targeting CD123 on LSC could promote ALL eradication.

To study the role of CART 123 in antigen-loss relapses a novel xenograft model of CD19-negative relapses was developed from primary blasts derived from a B-ALL patient (CHP101) enrolled in one of the CTL019 trials of the University of Pennsylvania/Children's Hospital of Philadelphia. This patient, at baseline had a classic CD19+CD123+ phenotype but then relapsed after CART19 treatment with CD19−CD123+ disease. Using this model, it was demonstrated CART123 could eradicate the relapsed disease, and in combination with CART19 could prevent antigen-loss relapse. This is the first demonstration of a dual CART combination in a clinically relevant, patient-derived model. In addition, through use of intravital imaging, it was shown that CART cells enter the marrow in less than 24 hours after intravenous injection, search for their targets, and slowdown in order to interact with cognate antigen-bearing cells. Furthermore, it was shown that a dual signaling CART123/19 was more effective than either CART alone or a pool of both CAR, consistent with previously published results.

Previously, it was shown the pre-clinical efficacy of anti-CD123 chimeric antigen receptor for the treatment of acute myeloid leukemia. CART123 causes hematopoietic toxicity due to recognition of CD123 on hematopoietic stem and progenitor cells, a potentially major challenge to clinical translation as profound stem cell toxicity could lead to permanent myeloablation. It was hypothesized that to minimize hematopoietic toxicity, a novel construct that activated T cells only upon co-engagement of CD19 and CD123 simultaneously could obviate this hematopoietic toxicity. Here it was found that CART cells receiving an activating signal from CD19 recognition and a stimulatory signal from CD123 recognition could kill B-ALL cells as well as avoid the profound hematopoietic toxicity that we have previously described. Although this concept was previously published using an artificial system of CD19/PSMA recognition, this clinically relevant construct represents a major advance in the field with a relatively clear path to clinical translation. Notably, although such a dual CAR design will likely be associated with reduced toxicity, it may leave unaddressed the issue of antigen loss relapse by making CAR recognition more, rather than less restrictive. However, if targeting of CD123 successfully eradicates ALL stem cells, this approach could be both safe and efficacious.

In summary, demonstrated here is a novel and effective strategy to the treatment of B-ALL by targeting CD123. This approach is particularly attractive since CD123 is expressed in rare CD19-negative malignant cells in some patients with B-ALL and is retained in antigen-loss relapses occurring after CD19-directed immunotherapies. Moreover, the combination of CART19 with CART123 can prevent the occurrence of CD19-negative relapses.

Example 8

Enhancing CART Function and Therapeutic Index in Combination with Checkpoint Inhibitors Chimeric antigen receptor T cell (CART) therapy has developed as a powerful and potentially curative therapy in hematological malignancies over the last few years. CD19 directed CART cells have resulted in impressive complete response rates of ~90% in acute lymphoblastic leukemia that are durable for the majority of patients. However, the overall response rates in other malignancies such as chronic lymphocytic leukemia are around 50%. This could be partially related to CART exhaustion and dysfunction induced by leukemia cells. In this example, the role of inhibitory receptors/pathways were evaluated in inducing CART cell dysfunction and exhaustion in hematological malignancies.

As a tumor model, the acute myeloid leukemia (AML) cell line (MOLM14) and primary AML samples were treated with CD33 or CD123 directed CART cells (comprising 41BB and CD3z stimulatory domains and a lentiviral vector, 1172 construct (SEQ ID NO: 707)).

Figure 41A:
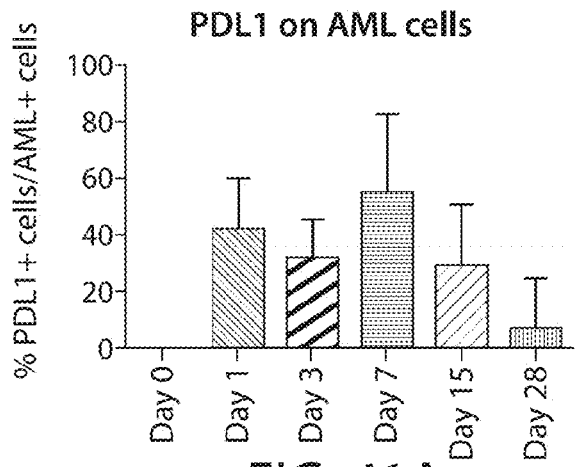
FIGS. 41A, 41B and 41C show the expression of PD1 L1 or on primary AML cells (FIG. 41A), and PD1 (FIG. 41B) and TIM3 (FIG. 41C) on T cells.
Figure 41B:
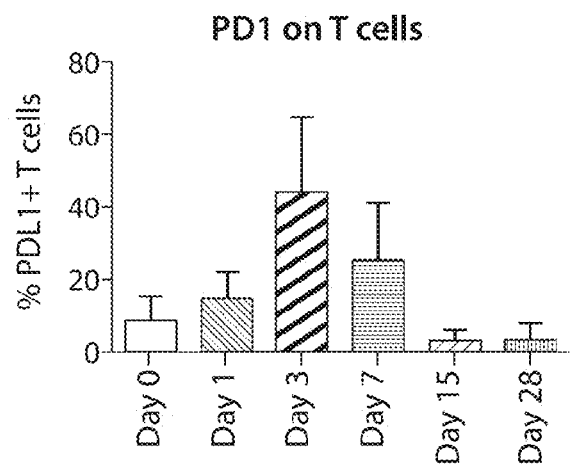
Figure 41C:
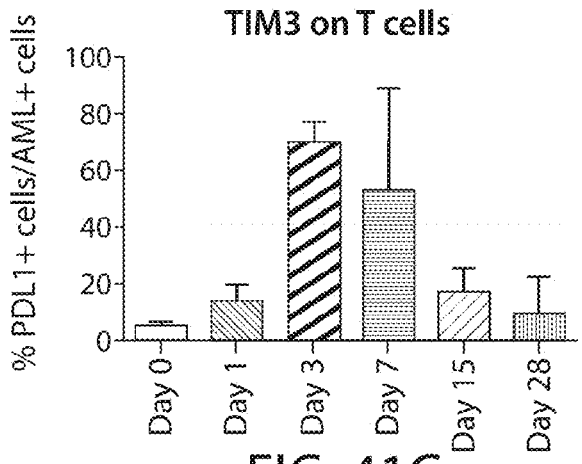
Figure 42A:
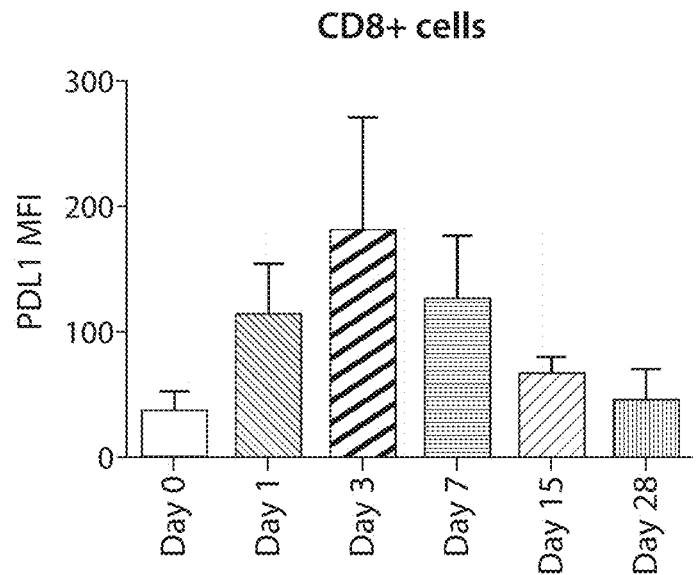
FIGS. 42A, 42B, 42C, and 42D show the expression of immune checkpoints PD1 (FIG. 42A), TIM3 (FIG. 42B), LAG3 (FIG. 42C), and CTLA4 (FIG. 42D) on CD8+ T cells.
Figure 42B:
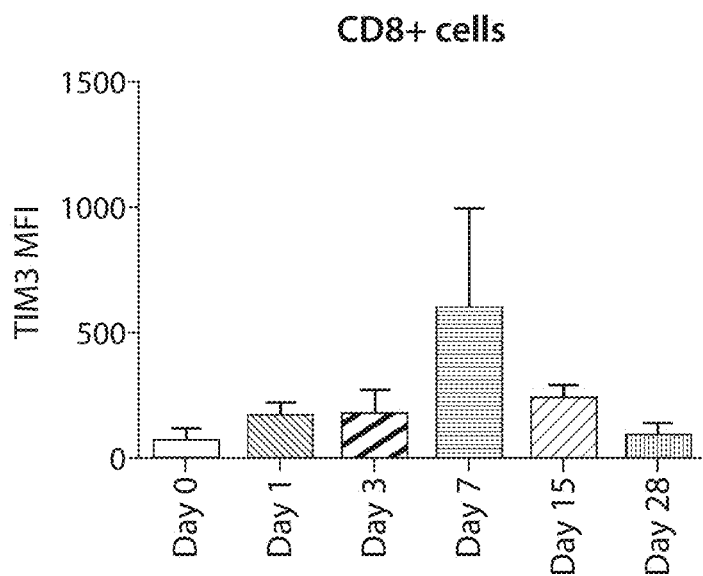
Figure 42C:
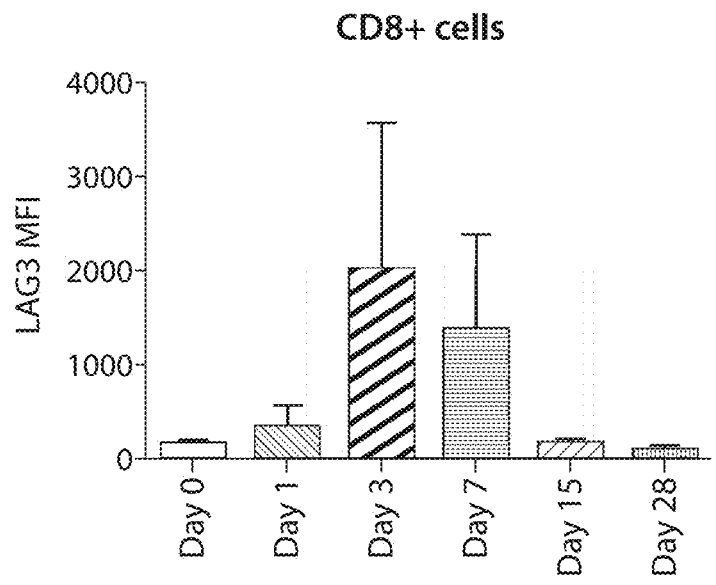
Figure 42D:
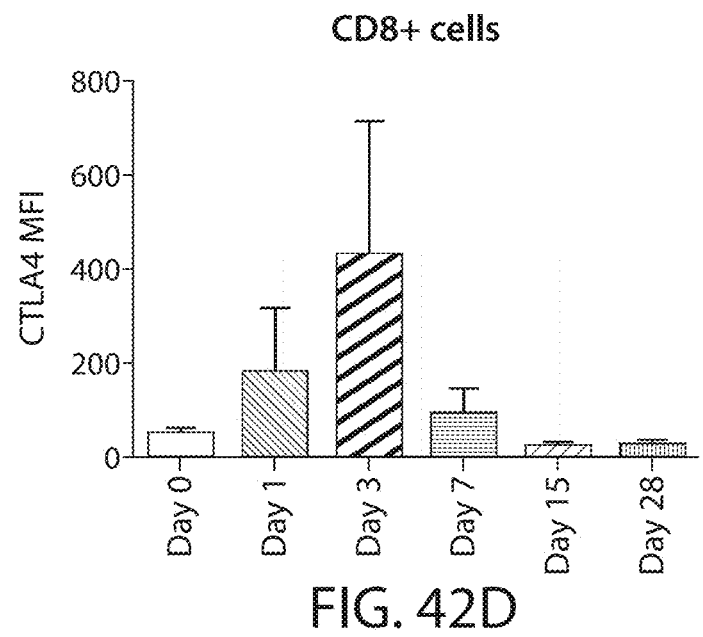

Incubation of primary AML samples or MOLM14 cell line with CD33 or CD123 directed CARTs resulted in a significant up-regulation of PDL1 on tumor cells after 24 hours of incubation (0% on day 0 vs 80% on day 1, P<0.001), and up-regulation of PD1 and TIM3 on T cells 3-7 days post co-culture (8% of T cells expressed PD1 on day 0 vs 43% on day 3, P=0.03 and 13% of T cells expressed TIM3 on day 0 vs 71% on day 3, p=0.001, FIGS. 41A, 41B, and 41C). Further flow cytometry analysis demonstrated upregulation of checkpoint inhibitors PD1, TIM3, and additional checkpoint inhibitors LAG3 and CTLA4, in CD8+ T cells (FIGS. 42A, 42B, 42C, and 42D) and in CD4+ T cells. Importantly, maximal expression was observed between days 3-7 after exposure to the target cells (primary AML or MOLM14 cells).

Figure 44:
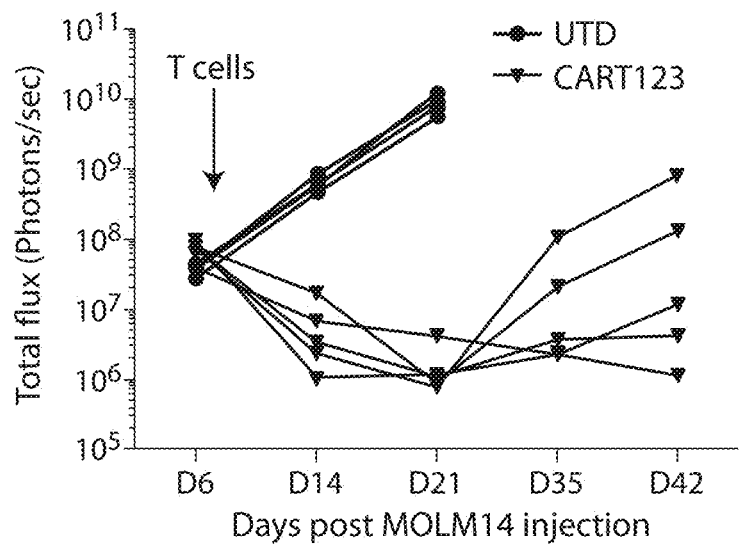
FIG. 44 shows the tumor burden (represented by bioluminescent imaging, photons/sec) after CART123 treatment compared to treatment with untransduced (UTD) cells.

For in-vivo experiments, NSG (NOD-SCID-g$^{-/-}$) mice were engrafted with MOLM14 cell line. Treatment of these AML xenografts with suboptimal doses of CD33 or CD123 CARTs resulted in initial anti-tumor responses, followed by disease relapses in 40-60% of the mice (FIG. 44).

Figure 43:
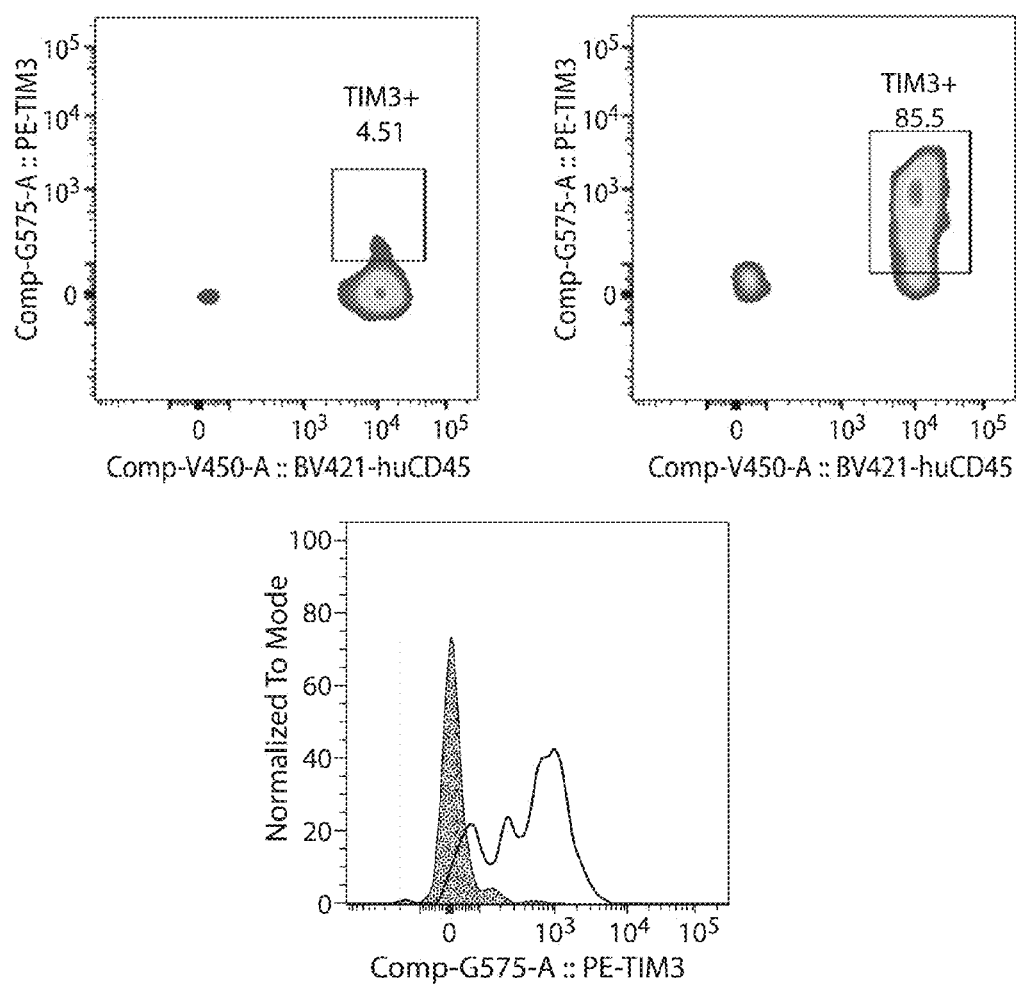
FIG. 43 shows flow cytometry analysis of TIM3 expression on AML baseline (left) and relapsed (right) samples.
Figure 45:
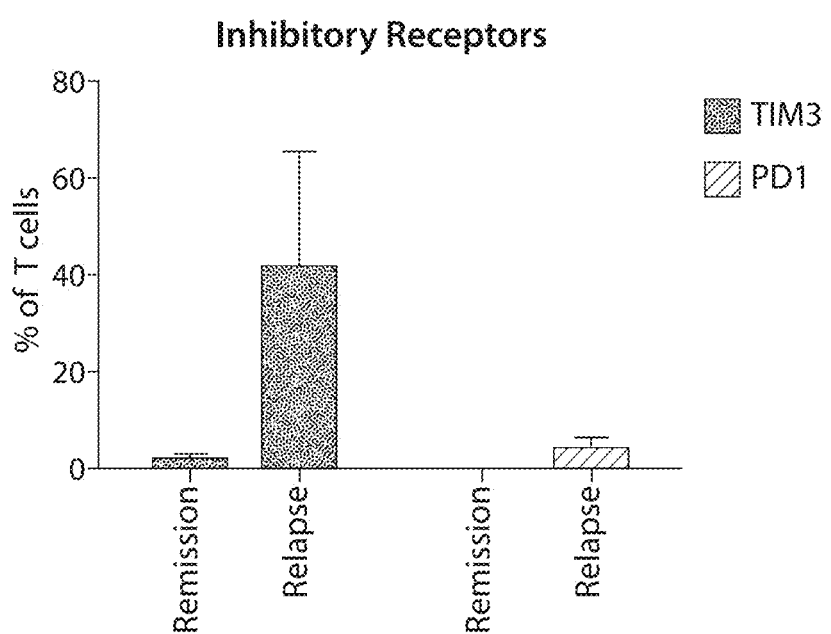
FIG. 45 shows the expression of TIM3 and PD1 on T cells in xenografts after CD123 treatment in remission or after relapse.

T cells were isolated from the bone marrow of these mice and analyzed for differential expression of inhibitory receptors. There was significant increased up-regulation of PD1 and TIM-3 receptors on T cells isolated from mice with relapsed disease compared T cells isolated from mice in remission after CART cell therapy (FIGS. 43 and 45).

Figure 46A:
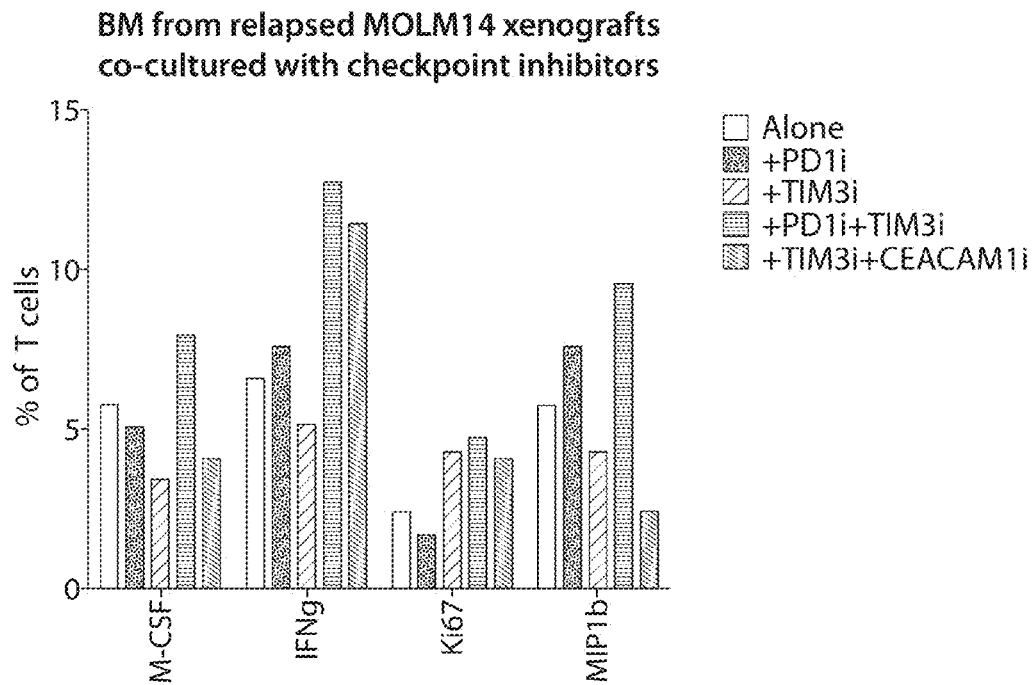
FIGS. 46A and 46B show the characterization of bone marrow from relapsed mice after coculture with checkpoint inhibitors, e.g., inhibitors of PD1, TIM3, a combination of PD1 and TIM3 inhibitors, or a combination of TIM3 and CEACAM-1 inhibitors. The percentage of T cells expressing GMCSF, IFNg, Ki67, and MIP1b was detected in the absence (FIG. 46A) or in the presence of PMA/IONO (FIG. 46B).
Figure 46B:
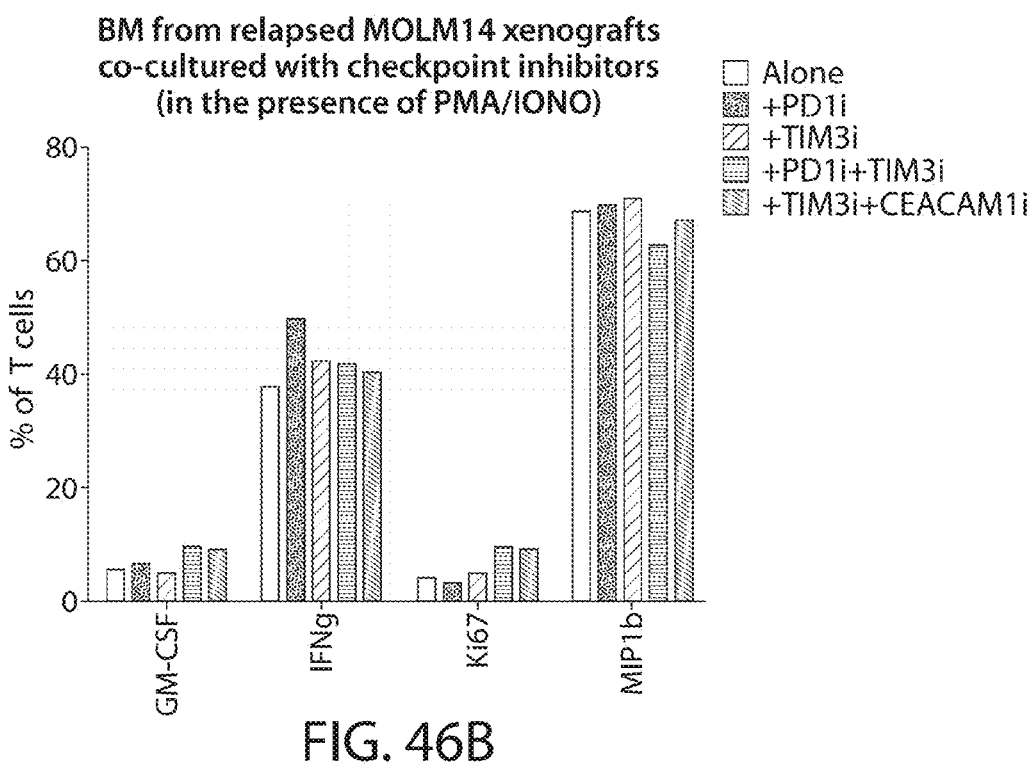

Next, the role of adding checkpoint inhibitors to improve T cell functions ex-vivo after CART cell therapy was investigated. T cells isolated from bone marrows of mice that relapsed after CART cell therapy were co-cultured, in the presence of tumor, with a PD-1 inhibitor (BioXcell, Catalog No. is BE0193 and clone# is J110), a TIM3 inhibitor (Biolegend, clone F38-2E2, Catalog No. 345010), a CEACAM inhibitor (Sigma-Aldrich, Catalog No. SAB1403604-100UG), or the combination of PD1 and TIM3 inhibitors, or the combination of PD1 and CEACAM1 inhibitors. The checkpoint inhibitors were administered at the concentration of 10 ug/ml. There was an improvement of CART cells effector functions as measured by cytokine production (e.g., IFN-gamma) and Ki-67 proliferation marker in the presence of checkpoint inhibitors. The improvement of the CART cell effector function was more pronounced when both PD1 and TIM3 inhibitors were combined (FIGS. 46A and 46B).

Figure 47:
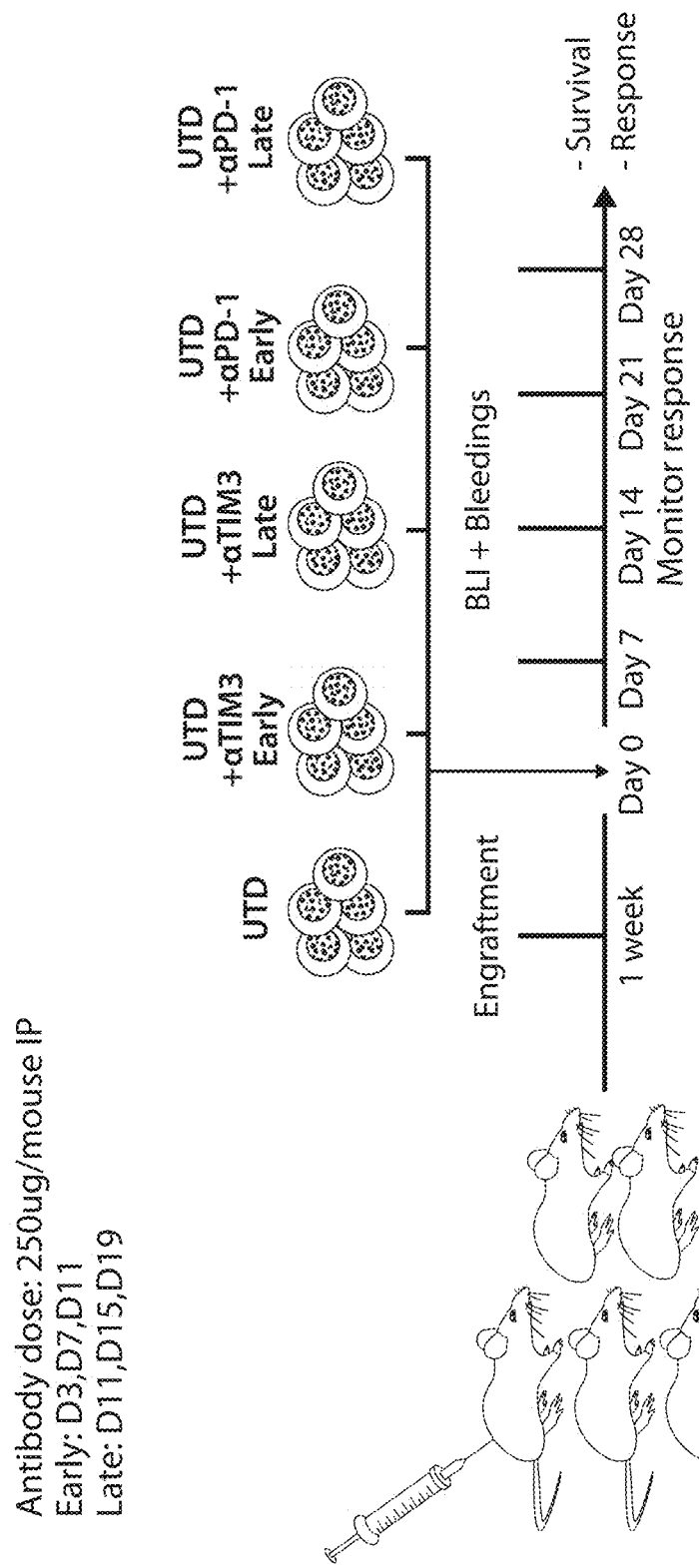
FIG. 47 shows the experimental schema for treating AML xenografts with untransduced cells and PD1 inhibitors or TIM3 inhibitors.
Figure 49:
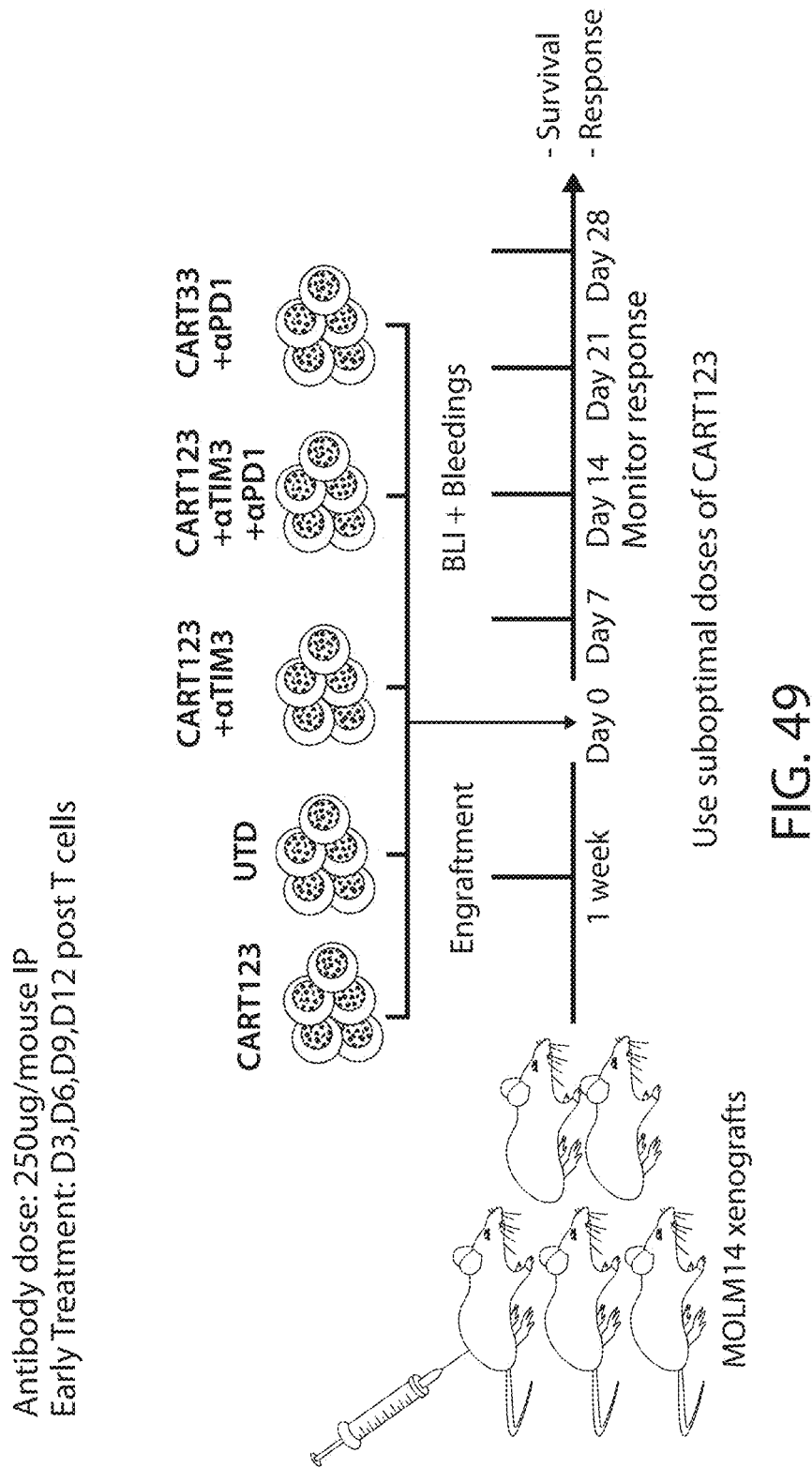
FIG. 49 shows the experimental schema for treating AML xenografts with CART123 in combination with TIM3 and/or PD1 inhibitors.

Finally, it was tested whether combining checkpoint inhibitors with CARTs would improve anti-tumor activity, e.g., augment the therapeutic index and prevent relapses in AML xenografts. In this approach, MOLM14 xenografts were treated with suboptimal doses of CD33 or CD123 directed CARTs or with control untransduced T cells (UTD), with or without different combinations of checkpoint inhibitors. NSG mice were engrafted with MOLM14 AML cell line. Engraftment was confirmed by bioluminescent imaging. The AML xenografts were then treated with suboptimal doses ($0.25$-$0.5 \times 10^6$ total T cells I.V) of CD33 or CD123 directed CARTs or with control untransduced T cells (UTD). Mice also received PD-1 blockade, TIM3 blockade or the combination of both on days 3, 6, 9 and 12 post T cells. Mice were followed with serial imaging to assess disease burden. The experimental schema is summarized in FIGS. 47 and 49.

Figure 48:
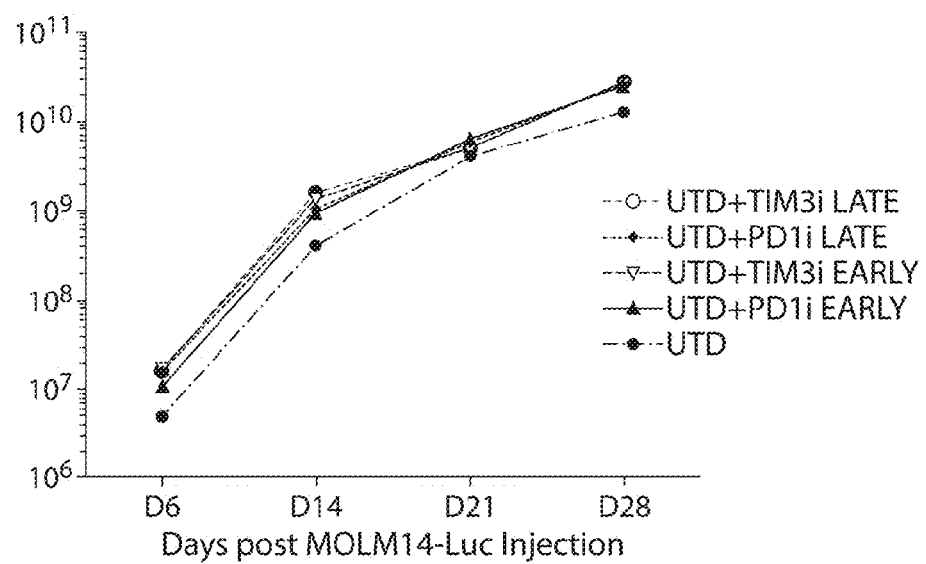
FIG. 48 shows the tumor burden (represented by BLI, photons/sec) for the experiment depicted in FIG. 47.
Figure 50A:
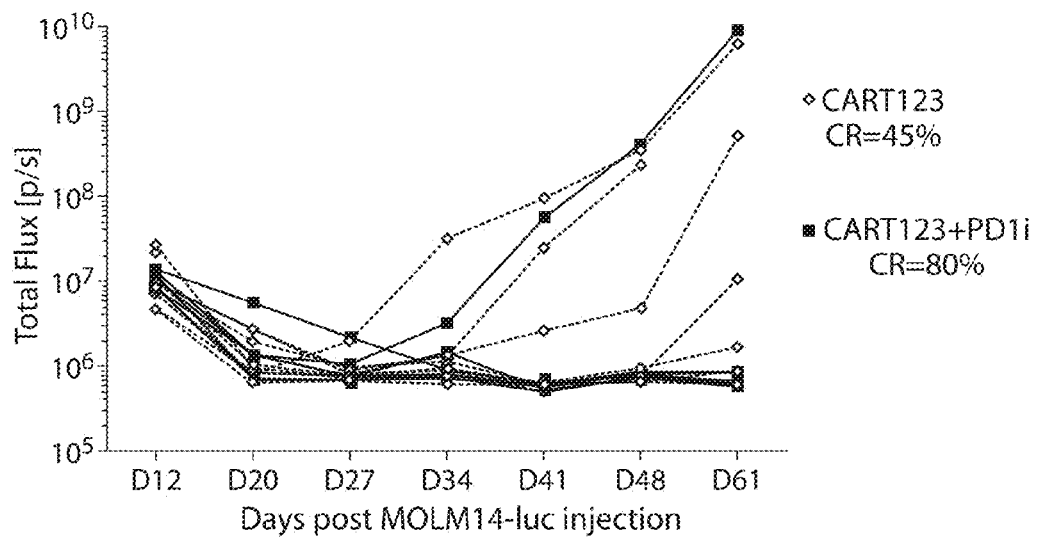
FIGS. 50A, 50B, 50C, and 50D show the tumor burden (represented by BLI, photons/sec) for the experiment depicted in FIG. 49.
Figure 50B:
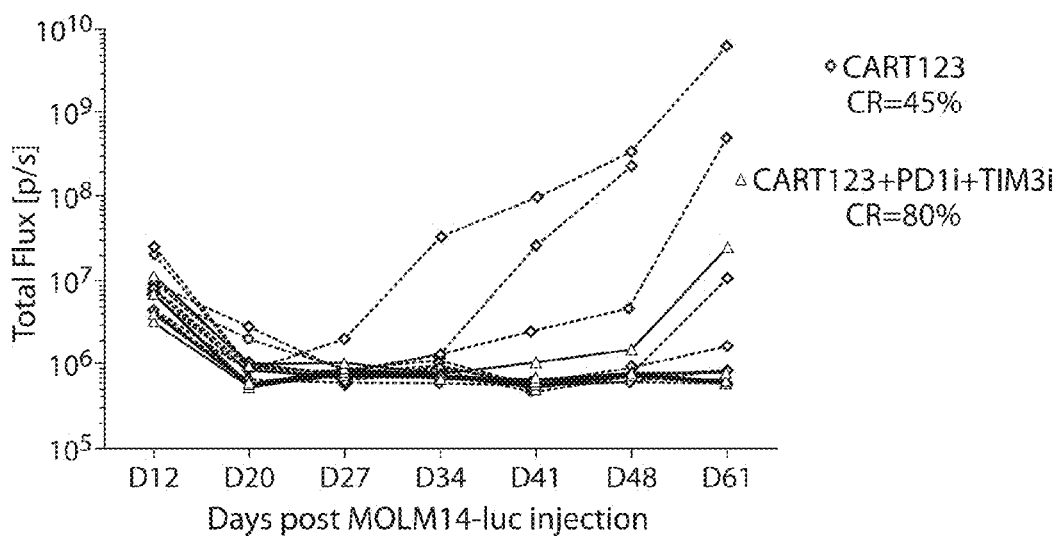
Figure 50C:
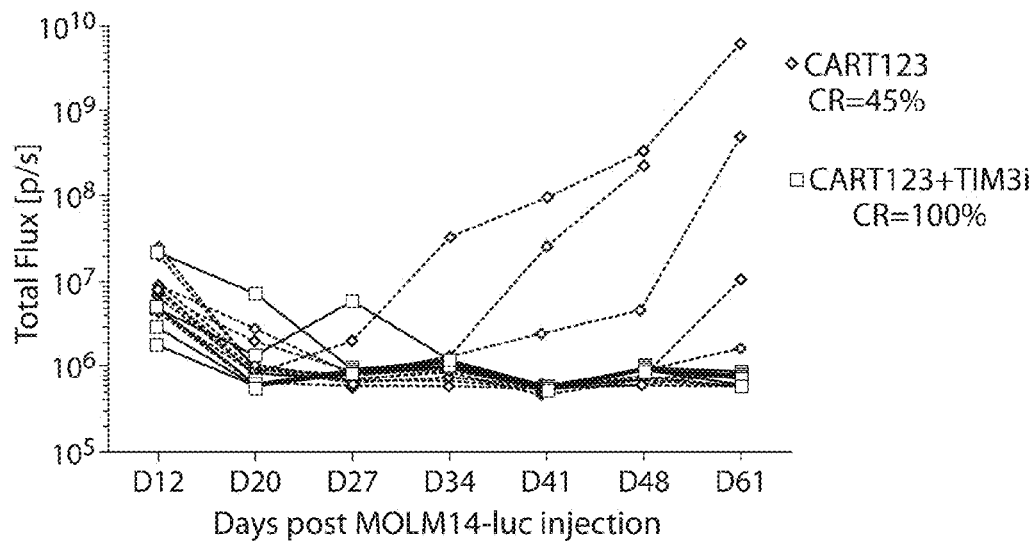
Figure 50D:
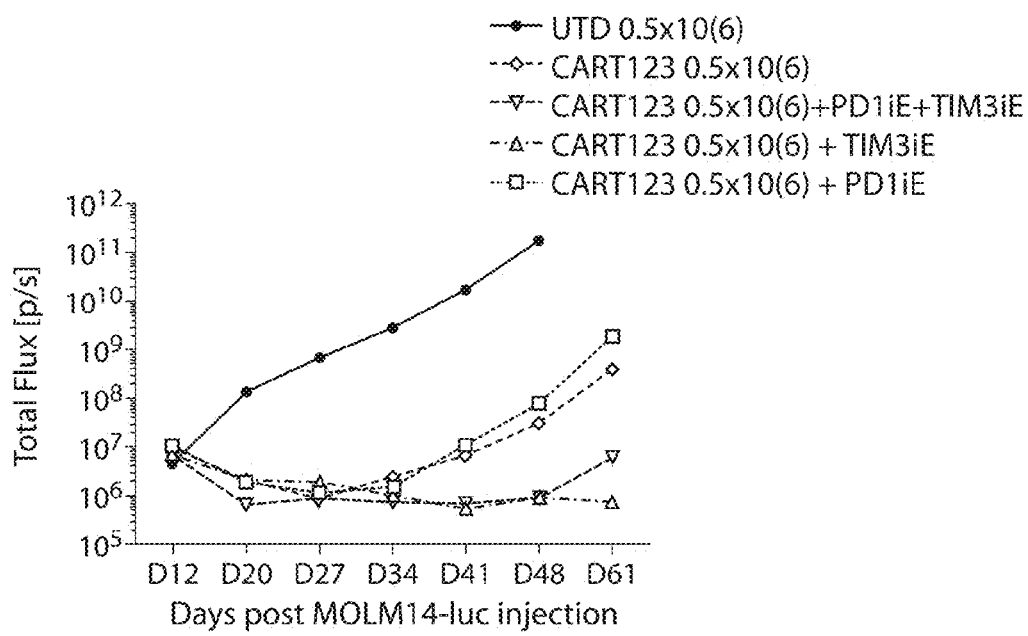
Figure 52:
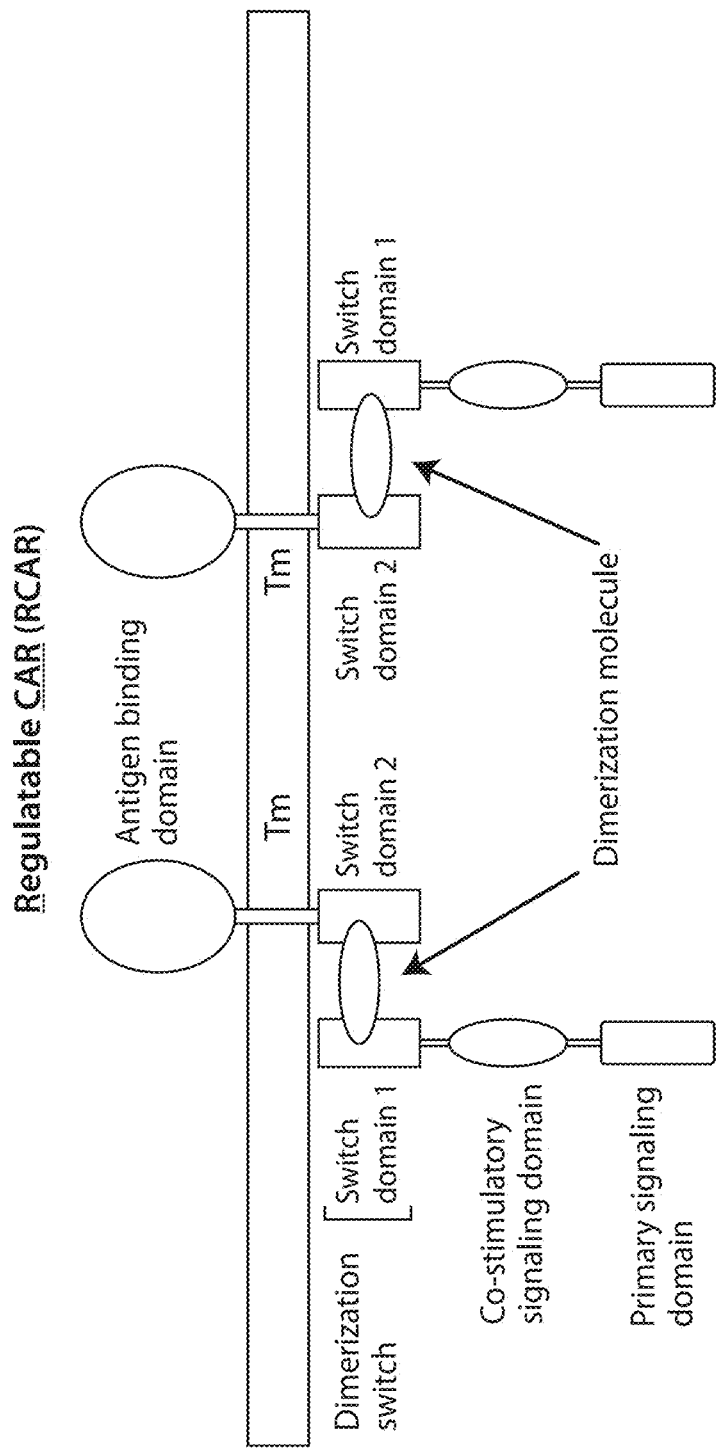
FIG. 52 depicts the structures of two exemplary RCAR configurations. The antigen binding members comprise an antigen binding domain, a transmembrane domain, and a switch domain. The intracellular binding members comprise a switch domain, a co-stimulatory signaling domain and a primary signaling domain. The two configurations demonstrate that the first and second switch domains described herein can be in different orientations with respect to the antigen binding member and the intracellular binding member. Other RCAR configurations are further described herein.

The addition of checkpoint inhibitors to untransduced T cells did not lead to an anti-leukemic effect (FIG. 48). However, the addition of PD1 or TIM3 blockade resulted in synergistic anti-tumor activity as shown in FIGS. 50A, 50B, 50C and 50D. The durable complete response rate was: 45% for treatment with CART123 alone (FIGS. 50A, 50B, and 50C), 80% for treatment with CART123+PD1 inhibition (FIG. 50A), 100% for treatment with CART123+TIM3 inhibition (FIG. 50B), and 80% for treatment with CART123+ both PD1 and TIM3 inhibition (FIG. 50C).

Thus, treatment with CART123 in combination with checkpoint inhibitors resulted in greater anti-tumor activity than the anti-tumor effect observed when administering CART123 combined with the anti-tumor effect observed when administering any of the checkpoint inhibitors alone. These results indicate that PD1 and TIM3 pathways are involved in CARTs exhaustion and dysfunction in AML. Combination of checkpoint inhibitors with CART cells can lead to enhanced functions in AML and other hematological malignancies.

Example 9

Low Dose RAD001 Stimulates CART Proliferation in a Cell Culture Model

The effect of low doses of RAD001 on CAR T cell proliferation in vitro was evaluated by co-culturing CART-expressing cells with target cells in the presence of different concentrations of RAD001.
Materials and Methods
Generation of CAR-transduced T Cells A humanized, anti-human CD19 CAR (huCART19) lentiviral transfer vector was used to produce the genomic material packaged into VSVg pseudotyped lentiviral particles. The amino acid and nucleotide sequence of the humanized anti-human CD19 CAR (huCART19) is CAR 1, ID 104875 described in PCT publication, WO2014/153270, filed Mar. 15, 2014, and is designated SEQ ID NOs. 85 and 31 therein.

Lentiviral transfer vector DNA is mixed with the three packaging components VSVg env, gag/pol and rev in combination with lipofectamine reagent to transfect Lenti-X 293T cells. Medium is changed after 24 h and 30 h thereafter, the virus-containing media is collected, filtered and stored at $-80°$ C. CARTs are generated by transduction of fresh or frozen naïve T cells obtained by negative magnetic selection of healthy donor blood or leukopak. T cells are activated by incubation with anti-CD3/anti-CD28 beads for 24 h, after which viral supernatant or concentrated virus (MOI=2 or 10, respectively) is added to the cultures. The modified T cells are allowed to expand for about 10 days. The percentage of cells transduced (expressing the CARs on the cell surface) and the level of CAR expression (relative fluorescence intensity, Geo Mean) are determined by flow cytometric analysis between days 7 and 9. The combination of slowing growth rate and T cell size approaching ~350 fL determines the state for T cells to be cryopreserved for later analysis.
Evaluating Proliferation of CARTs To evaluate the functionality of CARTs, the T cells are thawed and counted, and viability is assessed by Cellometer. The number of CAR-positive cells in each culture is normalized using non-transduced T cells (UTD). The impact of RAD001 on CARTs was tested in titrations with RAD001, starting at 50 nM. The target cell line used in all co-culture experiments is Nalm-6, a human pre-B cell acute lymphoblastic leukemia (ALL) cell line expressing CD19 and transduced to express luciferase.

Figure 53:
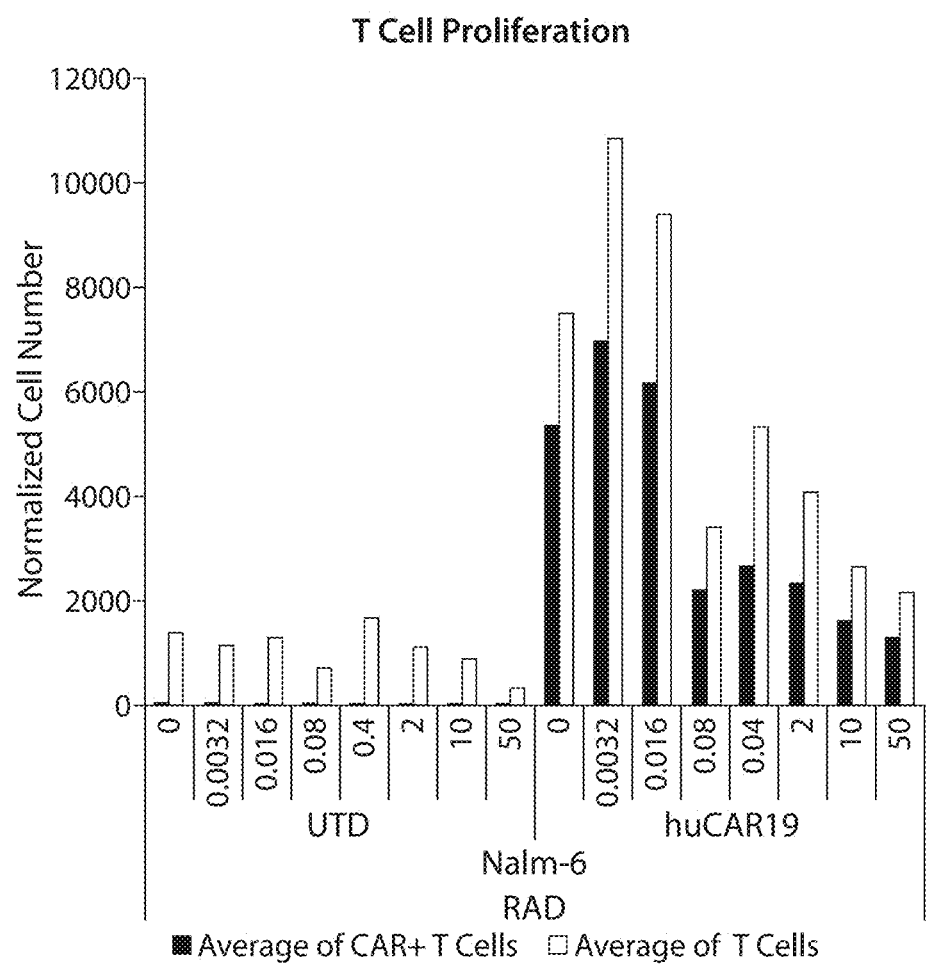
FIG. 53 shows that the proliferation of CAR-expressing, transduced T cells is enhanced by low doses of RAD001 in a cell culture system. CARTs were co-cultured with Nalm-6 cells in the presence of different concentrations of RAD001. The number of CAR-positive CD3-positive T cells (black) and total T cells (gray) was assessed after 4 days of co-culture.

For measuring the proliferation of CARTs, T cells are cultured with target cells at a ratio of 1:1. The assay is run for 4 days, when cells are stained for CD3, CD4, CD8 and CAR expression. The number of T cells is assessed by flow cytometry using counting beads as reference.
Results The proliferative capacity of CART cells was tested in a 4 day co-culture assay. The number of CAR-positive CD3-positive T cells (dark bars) and total CD3-positive T cells (light bars) was assessed after culturing the CAR-transduced and non-transduced T cells with Nalm-6 (FIG. 53). huCART19 cells expanded when cultured in the presence of less than 0.016 nM of RAD001, and to a lesser extent at higher concentrations of the compound. Importantly, both at 0.0032 and 0.016 nM RAD001 the proliferation was higher than observed without the addition of RAD001. The non-transduced T cells (UTD) did not show detectable expansion.

Example 10

Low Dose RAD001 Stimulates CART Expansion In Vivo

This example evaluates the ability of huCAR19 cells to proliferate in vivo with different concentrations of RAD001.
Materials and Methods:

NALM6-luc cells: The NALM6 human acute lymphoblastic leukemia (ALL) cell line was developed from the peripheral blood of a patient with relapsed ALL. The cells were then tagged with firefly luciferase. These suspension cells grow in RPMI supplemented with 10% heat inactivated fetal bovine serum.

Mice: 6 week old NSG (NOD.Cg-Prkdc$^{scid}$Il2rg$^{tm1wjl}$/Szb mice were received from the Jackson Laboratory (stock number 005557).

Tumor implantation: NALM6-luc cells were grown and expanded in vitro in RPMI supplemented with 10% heat inactivated fetal bovine serum. The cells were then transferred to a 15 ml conical tube and washed twice with cold sterile PBS. NALM6-luc cells were then counted and resuspended at a concentration of $10\times10^6$ cells per milliliter of PBS. The cells were placed on ice and immediately (within one hour) implanted in the mice. NALM6-luc cells were injected intravenously via the tail vein in a 100 µl volume, for a total of $1\times10^6$ cells per mouse.

CAR T cell dosing: Mice were administered $5\times10^6$ CAR T cells 7 days after tumor implantation. Cells were partially thawed in a 37 degree Celsius water bath and then completely thawed by the addition of 1 ml of cold sterile PBS to the tube containing the cells. The thawed cells were transferred to a 15 ml falcon tube and adjusted to a final volume of 10 mls with PBS. The cells were washed twice at 1000 rpm for 10 minutes each time and then counted on a hemocytometer. T cells were then resuspended at a concentration of $50\times10^6$ CAR T cells per ml of cold PBS and kept on ice until the mice were dosed. The mice were injected intravenously via the tail vein with 100 µl of the CAR T cells for a dose of $5\times10^6$ CAR T cells per mouse. Eight mice per group were treated either with 100 µl of PBS alone (PBS), or humanized CD19 CAR T cells.

RAD001 dosing: A concentrated micro-emulsion of 50 mg equal to 1 mg RAD001 was formulated and then resuspended in D5W (dextrose 5% in water) at the time of dosing. Mice were orally dosed daily (via oral gavage) with 200 µl of the desired doses of RAD001.

PK analysis: Mice were dosed daily with RAD001 starting 7 days post tumor implantation. Dosing groups were as follows: 0.3 mg/kg, 1 mg/kg, 3 mg/kg, and 10 mg/kg. Mice were bled on days 0 and 14 following the first and last dose of RAD001, at the following time points for PK analysis: 15 minutes, 30 minutes, 1 hour, 2 hours, 4 hours, 8 hours, 12 hours, and 24 hours.

Figure 54:
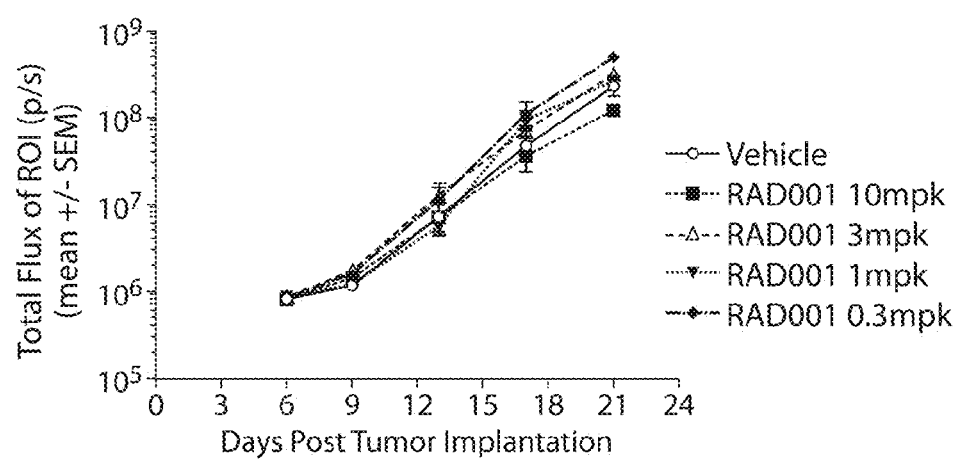
FIG. 54 depicts tumor growth measurements of NALM6-luc cells with daily RAD001 dosing at 0.3, 1, 3, and 10 mg/kg (mpk) or vehicle dosing. Circles denote the vehicle; squares denote the 10 mg/kg dose of RAD001; triangles denote the 3 mg/kg dose of RAD001, inverted triangles denote the 1 mg/kg dose of RAD001; and diamonds denote the 0.3 mg/kg dose of RAD001.
Figure 55A:
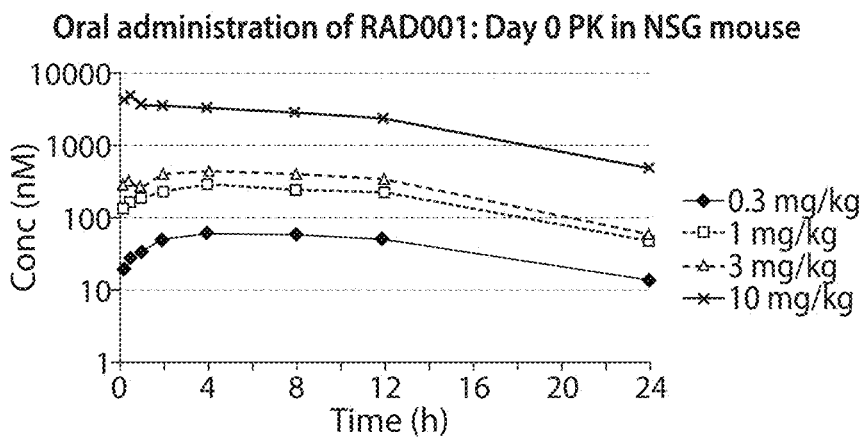
FIGS. 55A and 55B show pharmacokinetic curves showing the amount of RAD001 in the blood of NSG mice with NALM6 tumors.
Figure 55B:
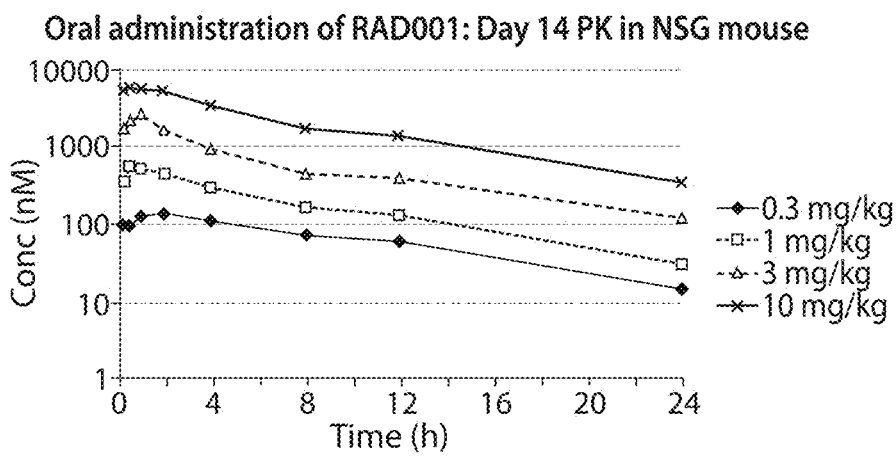

Results:

The expansion and pharmacokinetics of RAD001 was tested in NSG mice with NALM6-luc tumors. Daily oral dosing of RAD001 alone did not have an impact on the growth of NALM6-luc tumors (FIG. 54). The pharmacokinetic analysis of RAD001 shows that it is fairly stable in the blood of tumor bearing mice (FIGS. 55A and 55B). Both the day 0 and day 14 PK analyses show that the RAD001 concentrations in the blood is above 10 nm even 24 hours after dosing at the lowest dose tested (0.3 mg/kg).

Based on these doses, huCAR19 CAR T cells were dosed with and without RAD001 to determine the proliferative ability of these cells. The highest dose used was 3 mg/kg based on the levels of RAD001 in the blood 24 hours after dosing. As the concentration of RAD001 was above 10 nM 24 hours after the final dose of RAD001, several lower doses of RAD001 were used in the in vivo study with CAR T cells. The CAR T cells were dosed IV one day prior to the start of the daily oral RAD001 dosing. Mice were monitored via FACS for T cell expansion.

Figure 56A:
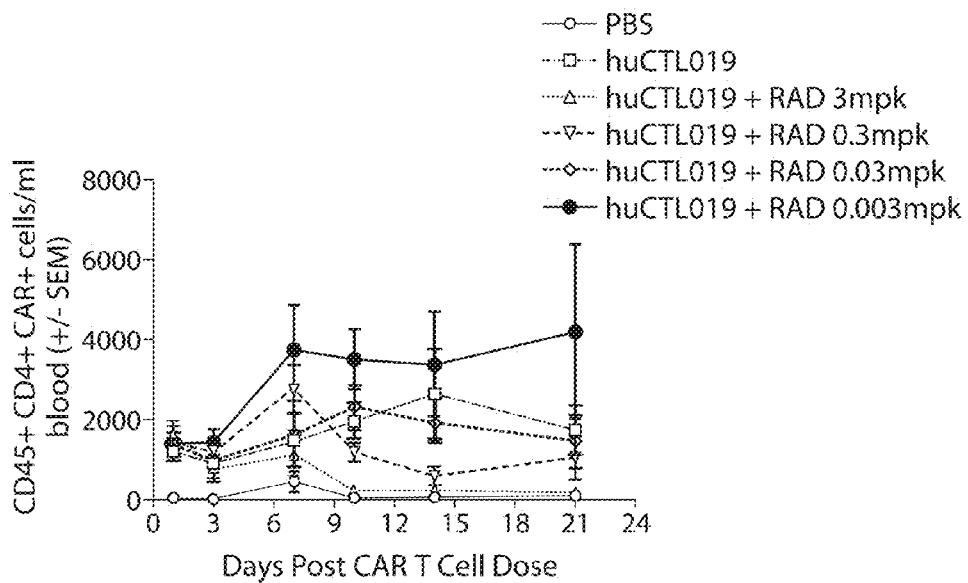
FIGS. 56A and 56B show in vivo proliferation of humanized CD19 CART cells with and without RAD001 dosing. Low doses of RAD001 (0.003 mg/kg) daily lead to an enhancement in CAR T cell proliferation, above the normal level of huCAR19 proliferation.
Figure 56B:
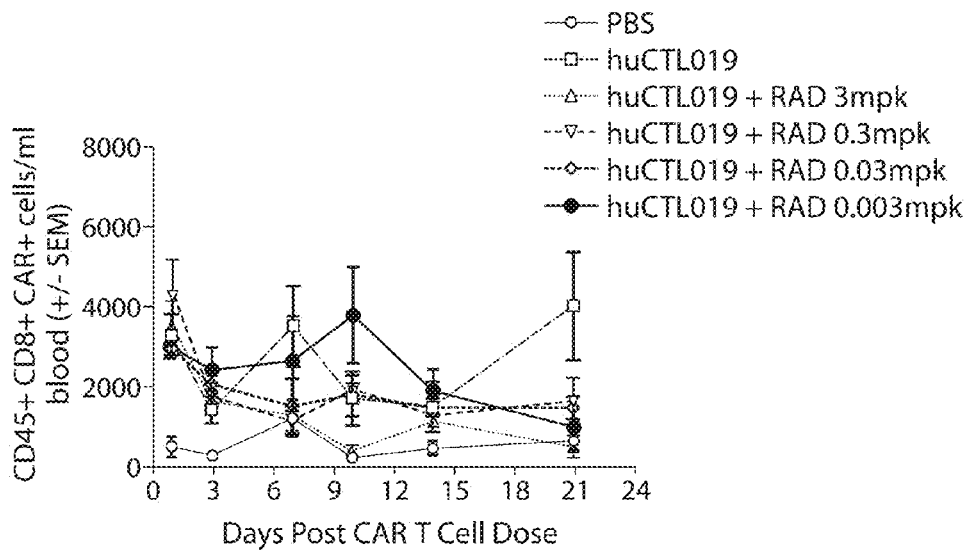

The lowest doses of RAD001 show an enhanced proliferation of the CAR T cells (FIGS. 56A-56B). This enhanced proliferation is more evident and prolonged with the CD4$^+$ CAR T cells than the CD8$^+$ CAR T cells. However, with the CD8$^+$ CAR T cells, enhanced proliferation can be seen at early time points following the CAR T cell dose. In embodiments, a RNA CART cell can also be used in combination with checkpoint inhibitors.

Example 11

In Vitro Characterization of CART123 Termination Strategy

Termination strategies are of particular interest for minimizing toxicity of CART123 therapy. One strategy for reducing CART123 activity involves the ablation of CD123 CAR-expressing T cells by co-expressing CAR123 with CD20, and using anti-CD20 antibody rituximab to target the CART123 cells for destruction. In this example, a CART123 cell is generated that co-expresses CD20, and characterized by various in vitro assays, such as degranulation and cytokine production capacity.

Figure 57:
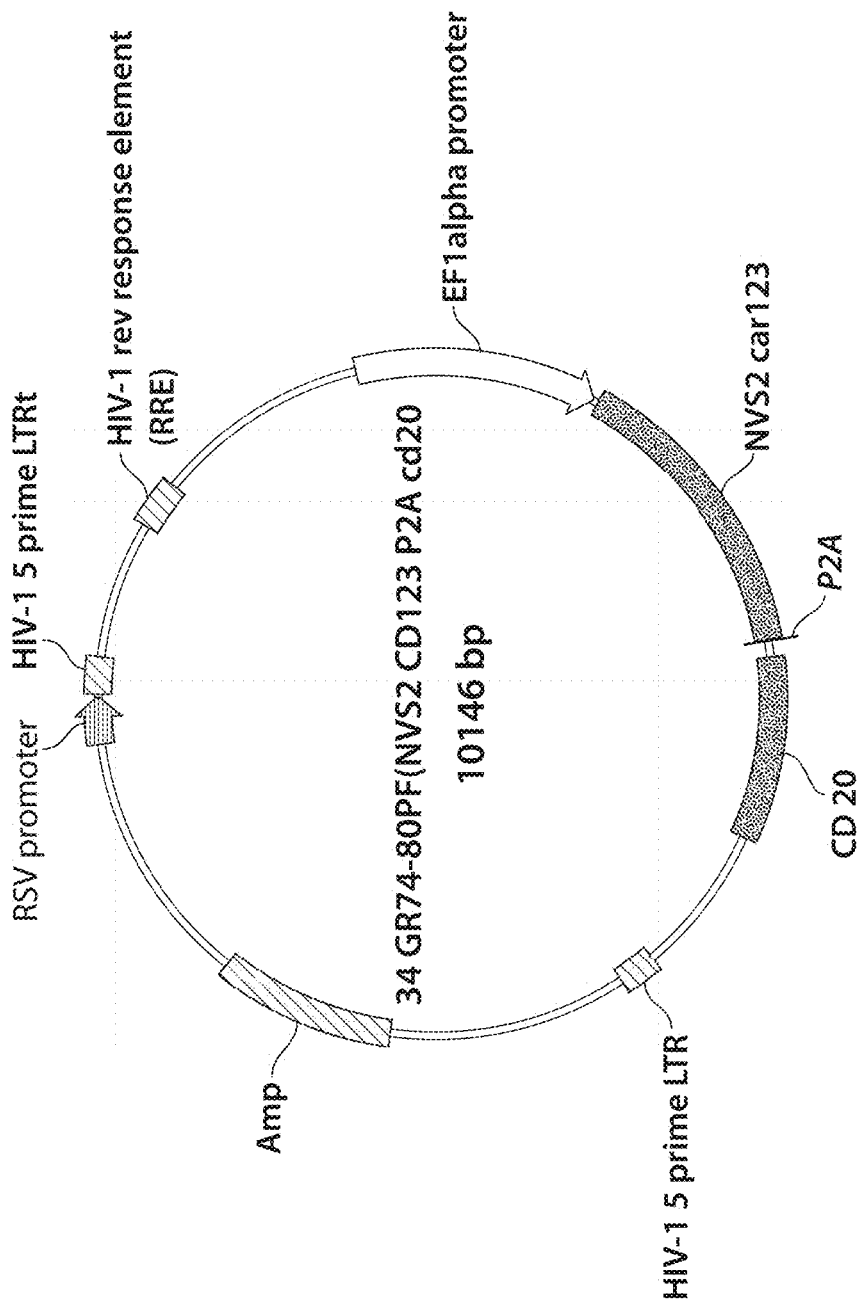
FIG. 57 is a vector map of a lentiviral vector for expressing a CAR123 and CD20 in a strategy for terminating CART123 activity, where the CAR123 sequence and the CD20 sequence are linked by a P2A sequence.

An expression vector for expressing a CD123 CAR and CD20 was constructed. The map of the vector is shown in FIG. 57. NVS2 CAR123 (also referred to herein as CAR123-2) is composed of a humanized single chain variable fragment directed against CD123, CD8 hinge, CD8 transmembrane domain, 41BB and CD3 stimulatory domains. NVS2 CAR123 is under EF1alpha promoter and is operably linked to the full CD20 molecule with a P2A protein. Cells expressing CAR123 only are referred to herein as CART123 cells, and cells co-expressing CAR123 and CD20 are referred to herein as CART123P2ACD20 cells.

Figure 58:
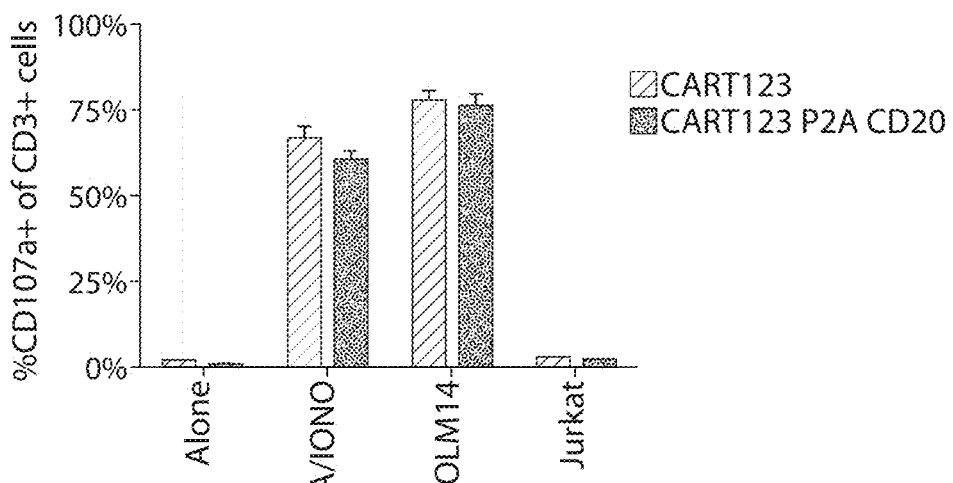
FIG. 58 shows the results of a CD107 degranulation assay comparing CART123 to CART123 P2A CD20 cells.

For the CD107 degranulation assay, CART123 and CART123P2A CD20 cells were cultured alone, with the CD123 positive cell line MOLM14, the CD123 negative control cell line Jurkat, and with PMA/Ionomycin as a positive control, in the presence of CD28, CD49d costimulatory molecules and monensin. CD107a was measured by flow cytometry after 4 hours of incubation. CART123 P2A CD20 cells undergo robust specific CD107a degranulation in response to CD123 positive target, similar to CART123 cells (FIG. 58), thereby demonstrating that the introduction of CD20 molecule does not adversely impact the degranulation of CART123 cells.

Figure 59A:
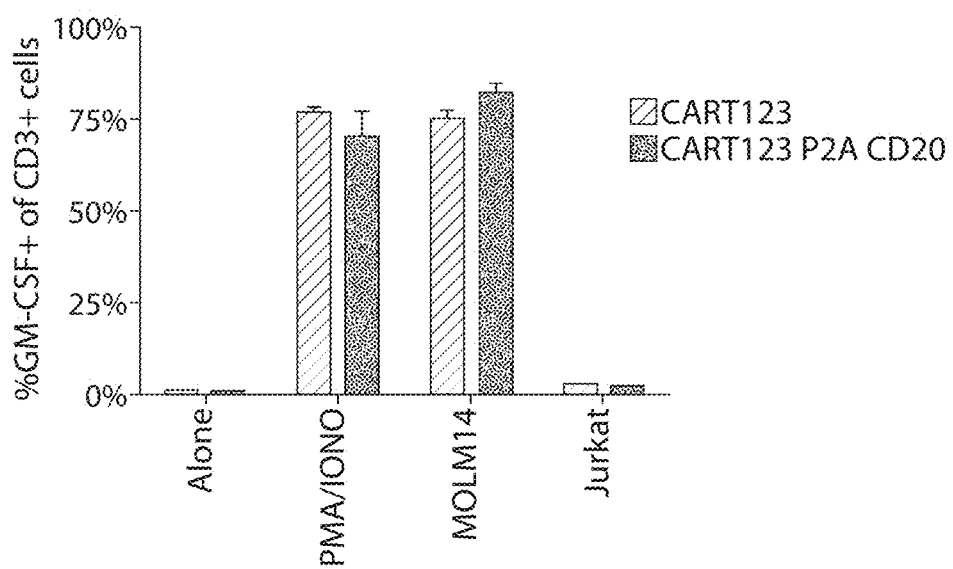
FIGS. 59A, 59B, 59C, and 59D show the production of GM-CSF (FIG. 59A), TNFalpha (FIG. 59B), IFNgamma (FIG. 59C), and IL-2 (FIG. 59D) by CART123 cells compared to CART123 P2A CD20 cells.
Figure 59B:
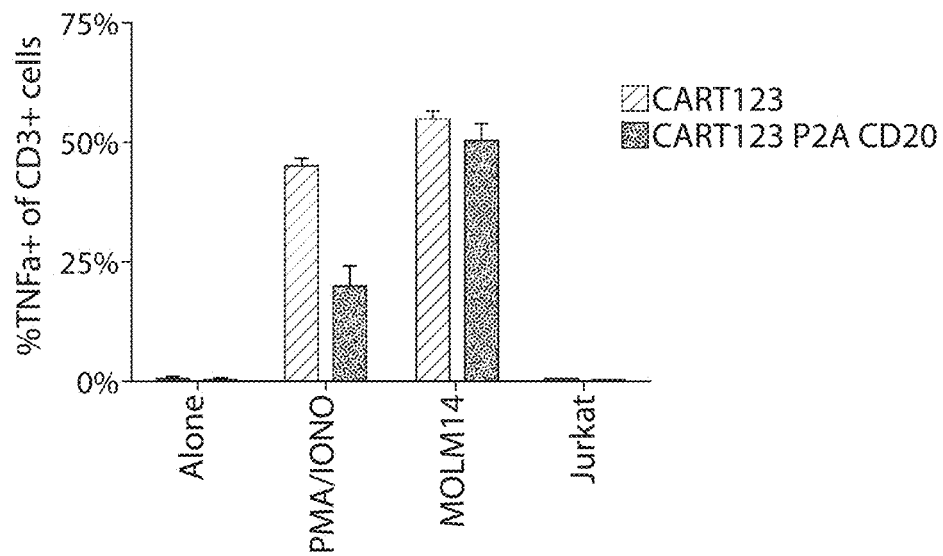
Figure 59C:
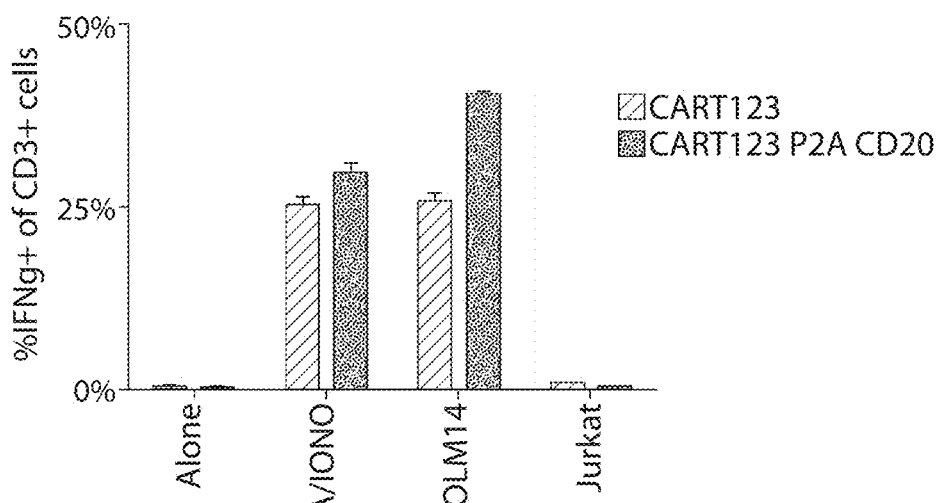
Figure 59D:
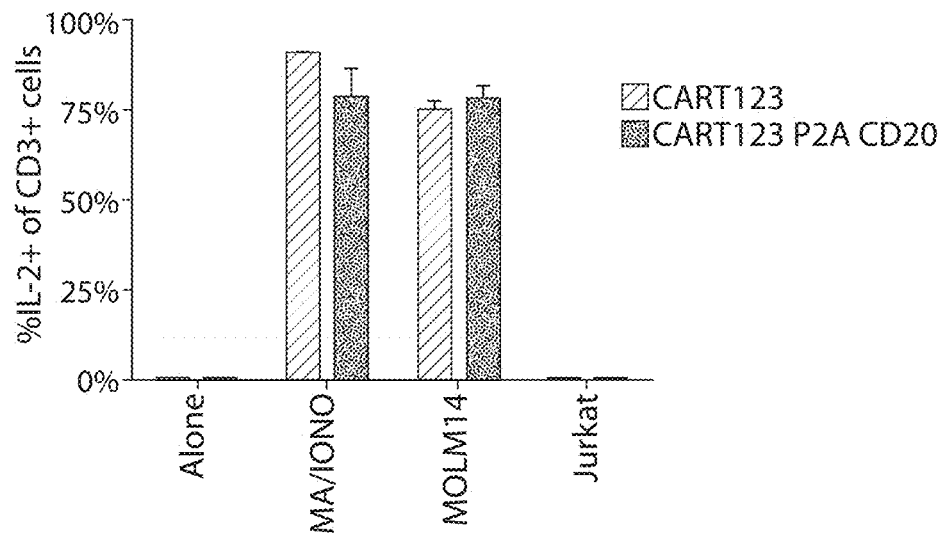

Cytokine production of the CART123P2A CD20 cells was also assessed. CART123 and CART123P2A CD20 cells were cultured alone, with the CD123 positive cell line MOLM14, the CD123 negative control cell line Jurkat, and with PMA/Ionomycin as a positive control, in the presence of CD28, CD49d costimulatory molecules and monensin. The cells were harvested after four hours, fixed and permeabilized, stained for cytokines GM-CSF, TNFα, IFNγ, or IL-2, and flow cytometric analyses were performed. Results from these assays demonstrated that the majority of CART123 P2A CD20 cells produce GM-CSF (FIG. 59A), TNFα (FIG. 59B), IFNγ (FIG. 59C), and IL-2 (FIG. 59D) in response to CD123 positive target, similar to CART123 cells.

Figure 60:
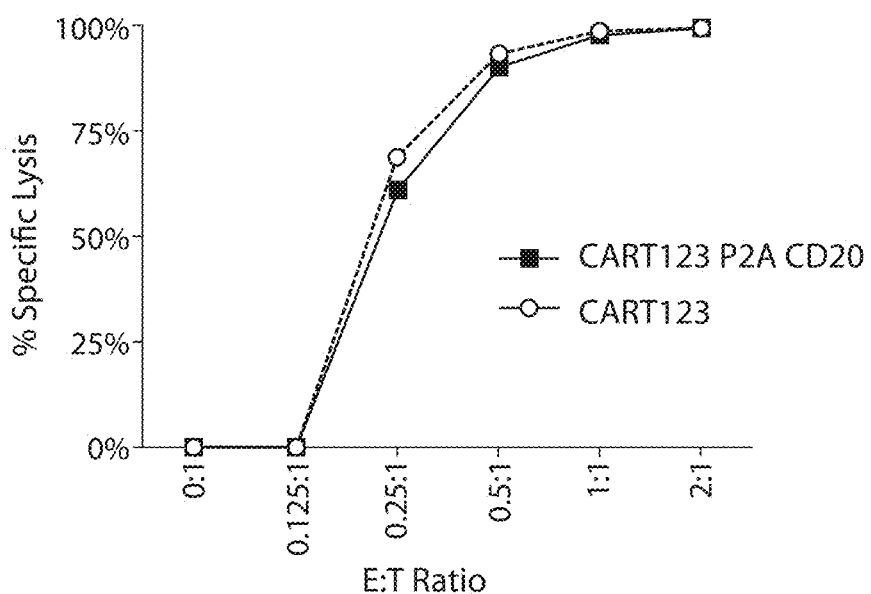
FIG. 60 shows the cytotoxic capability (as represented by % specific lysis) of CART123 cells compared to CART123 P2A CD20 cells when incubated at the indicated effector: target cell ratios.

In a cytotoxicity assay, CART123 and CART123P2A CD20 cells were incubated with MOLM14-luc for 24 h at different E:T ratios as indicated, and bioluminescence imaging was then performed as a measure of residual living cells. The results showed that CART123 P2A CD20 cells result specific killing of the CD123 positive target MOLM14, that is comparable to CART123 cells (FIG. 60).

Figure 61A:
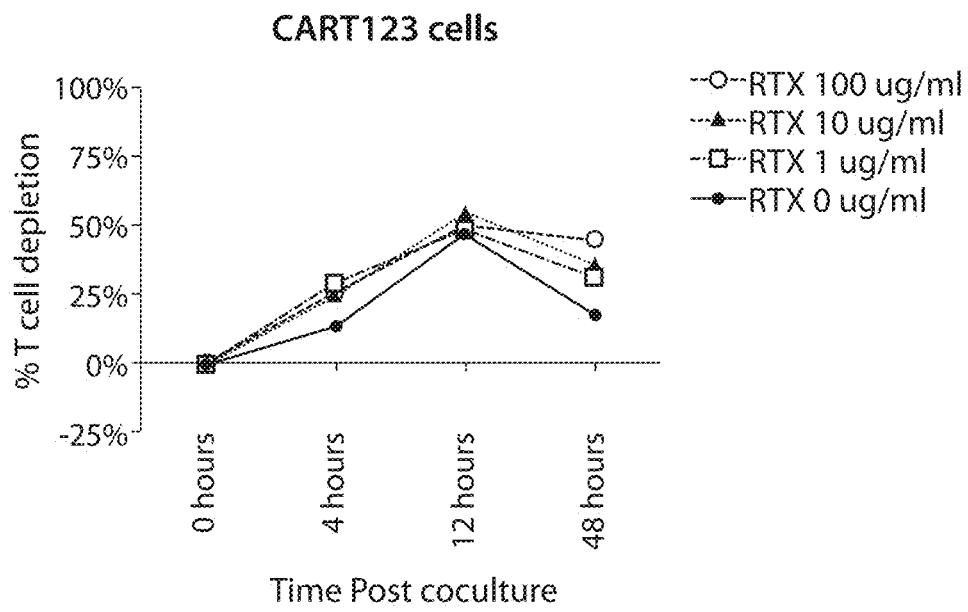
FIGS. 61A and 61B show T cell depletion after treatment with the indicated doses of rituximab on CART123 cells (FIG. 61A) and CART123 P2A CD20 cells (FIG. 61B).
Figure 61B:
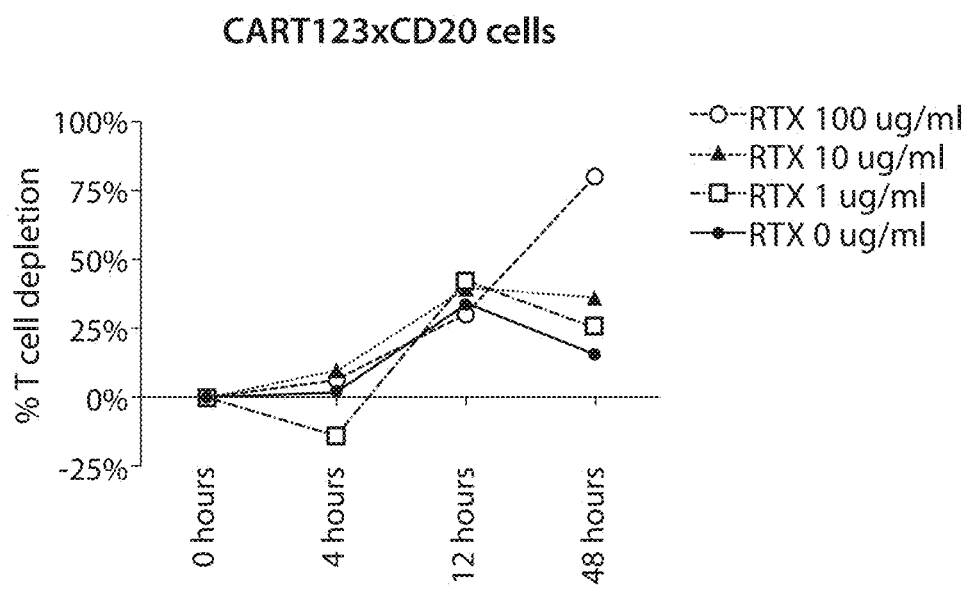

Rituximab-mediated cytotoxicity was next assessed for the CART123 P2A CD20 cells. CART123 and CART123 P2A CD20 were incubated with Rituximab at various concentrations, 0 µg/ml, 1 µg/ml, 10 µg/ml and 100 µg/ml. Cells were harvested at 0, 4, 12, and 48 hours, and stained for CD3. The percentage of T cell depletion was computed. Rituximab led to direct cytotoxicity, at the concentration of 100 ug/ml and after 48 hours of incubation in CART123P2A CD20 cells (FIG. 61B) but not in the CART123 cells (FIG. 61A).

Figure 62:
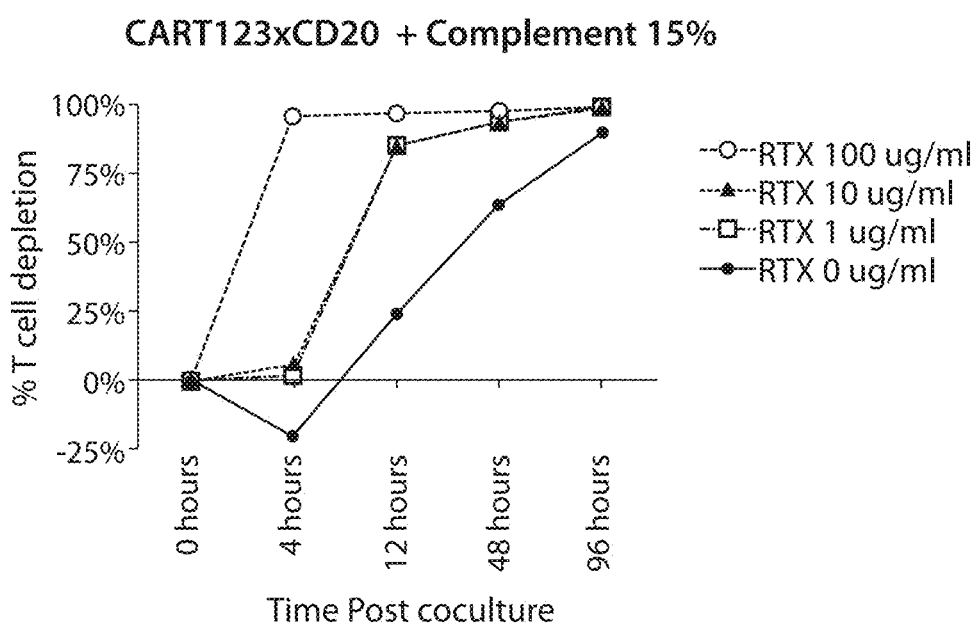
FIG. 62 shows the T cell depletion after treatment with the indicated doses of rituximab on CART123 P2A CD20 cells in the presence of 15% complement.

The mechanism by which the CART123P2ACD20 cell depletion is mediated was investigated. CART123 P2A CD20 cells were incubated with rituximab at different concentrations 0 μg/ml, 1 μg/ml, 10 μg/ml and 100 μg/ml, in the presence of 15% rabbit complement. As shown in FIG. 62, rituximab 1 μg/ml or 10 μg/ml resulted in depletion of the majority of CART123 P2A CD20 cells after 12 hours of incubation. Rituximab 100 ug/ml resulted in depletion of the majority of CART123 P2A CD20 cells after 4 hours of incubation. CART123 P2A CD20 cell depletion is mediated by complement dependent cytotoxicity.

Example 12

Efficient Termination Strategies of CD123 CARTs

Many children and adults with acute myeloid leukemia (AML) relapse or are incurable with current treatment modalities, highlighting a need for alternative therapies. Chimeric antigen receptor T cells targeting CD123 (CART123) have demonstrated potent anti-leukemia activity in murine xenograft models of human AML. However, CART123 treatment of mice engrafted with normal human hematopoietic cells resulted in profound myeloablation, raising concerns for severe hematologic toxicity in patients with AML who may be treated with such therapies. Here, it was evaluated whether T cell deletion after CART123-induced eradication of AML could minimize this bystander toxicity without impairing leukemia control, and thereby increase the therapeutic window of anti-AML CAR T cell immunotherapy.

Methods

Three termination strategies in human AML xenograft models were examined: (1) T cell ablation with the anti-CD52 antibody alemtuzumab after treatment with $1\times10^5$-$1\times10^6$ T cells lentivirally-transduced with anti-CD123-41BB-CD3zeta CART123, (2) T cell ablation with the anti-CD20 antibody rituximab after treatment with $1\times10^5$-$1\times10^6$ CART123 engineered to co-express CD20 (CART123/CD20), and (3) treatment with "biodegradable" anti-CD123 mRNA-electroporated CAR T cells (RNA-CART123). Mice engrafted with luciferase-expressing human AML cell lines (MOLM14, MOLM13, U937) or primary AML specimens (n=3) were treated with CD123-redirected CAR T cells as above. The CD123 CAR construct utilized for this experiment is the 1172 construct (SEQ ID NO: 707), and were administered to the mice at week 1. For T cell depletion studies, alemtuzumab 1 or 5 mg/kg was injected intraperitoneally (IP) at week 2, week 3, or week 4 (e.g., 1, 2, or 3 weeks post-CART123) to determine optimal dosing and timing of T cell ablation. In subsequent studies, rituximab 10 mg/kg was injected IP 4 weeks after CART123/CD20, or $1\times10^7$ RNA-CART123 was injected intravenously at 5, 9, and 16 days after AML engraftment. Mice were followed by weekly bioluminescent imaging and/or quantitative flow cytometry analyses of blood, spleen, and/or bone marrow.

Results

CART123 treatment of CD123+AML xenografts induced marked T cell expansion and leukemia eradication in vivo, resulting in long-term animal survival ($p<0.0001$ vs untransduced T cell-treated controls). Minimal xenogeneic graft-versus-host effects were observed.

Figure 72A:
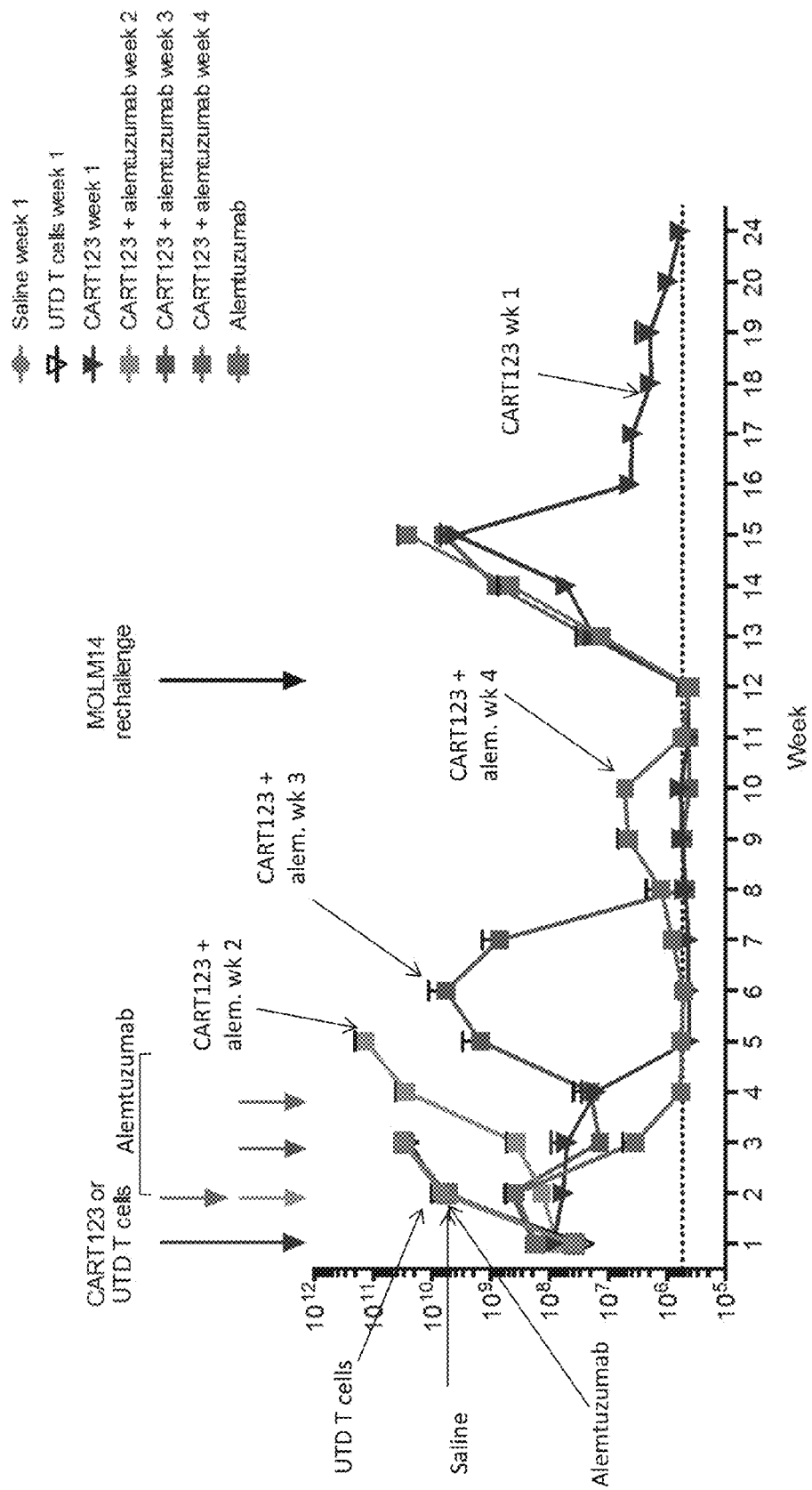

The results from serial ablation of CART123 in the xenograft model by alemtuzumab administration are shown in FIG. 72A. Quantification of CART123 cells was also performed at the corresponding timepoints (FIG. 72B) and show that the single doses of alemtuzumab rapidly eliminated CART123 cells. One dose of alemtuzumab rapidly eliminated T cells in all tested models with best efficacy of 5 mg/kg dosing at week 4 (e.g., 3 weeks post-CART123). Analysis of overall survival is shown in FIG. 72C, demonstrating that mice receiving alemtuzumab at week 3 or week 4 showed improved survival compared to the mice receiving alemtuzumab at week 2.

CART123/CD20 eradicated AML with similar kinetics to those of CART123, and 1 dose of rituximab at 4 weeks post-CART123/CD20 infusion rapidly eliminated T cells while preserving leukemia remission. Mice with CART123- or CART123/CD20-induced AML remission at time of alemtuzumab or rituximab administration remained leukemia-free for >12 weeks (FIG. 72A), and animal survival did not differ from that of CD123-redirected CAR T cell-treated mice that did not undergo T cell depletion (p=1.00). Conversely, CART123-treated mice with residual AML at time of earlier alemtuzumab administration experienced rapid AML progression, consistent with effective prior T cell elimination (FIG. 72A).

Furthermore, AML rechallenge ("relapse") of animals with previously alemtuzumab- or rituximab-ablated T cells resulted in rapid AML proliferation without T cell re-emergence, confirming the completeness of T cell depletion. Non-ablated mice demonstrated CAR T cell re-expansion with rejection of CD123+ rechallenge ($p<0.0001$) (FIG. 72A).

Figure 73A:
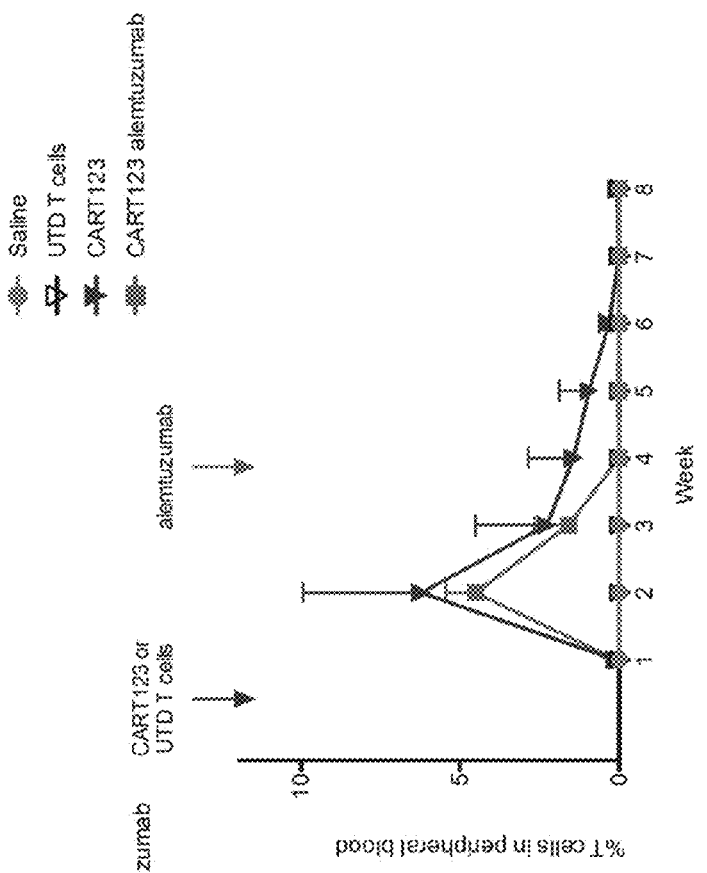
FIGS. 73A and 73B show the results of T cell ablation using alemtuzumab after treatment with lentivirally transduced CART123 cells in a pediatric AML xenograft model. CART123 cells or untransduced (UTD) cells were administered to mice 6 weeks after primary AML cell engraftment (week 0). Alemtuzumab was administered at week 4 to mice that received CART123 treatment.
Figure 73B:
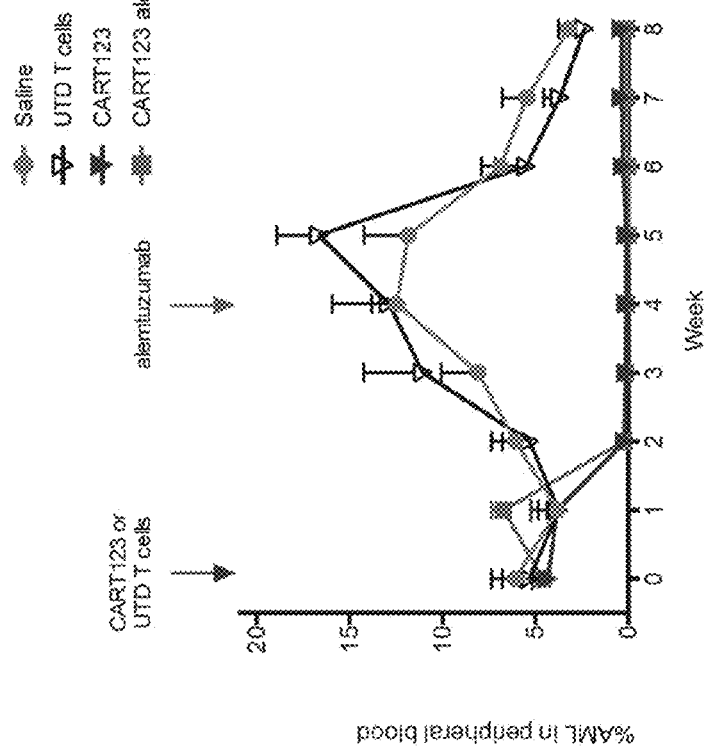
Figure 74A:
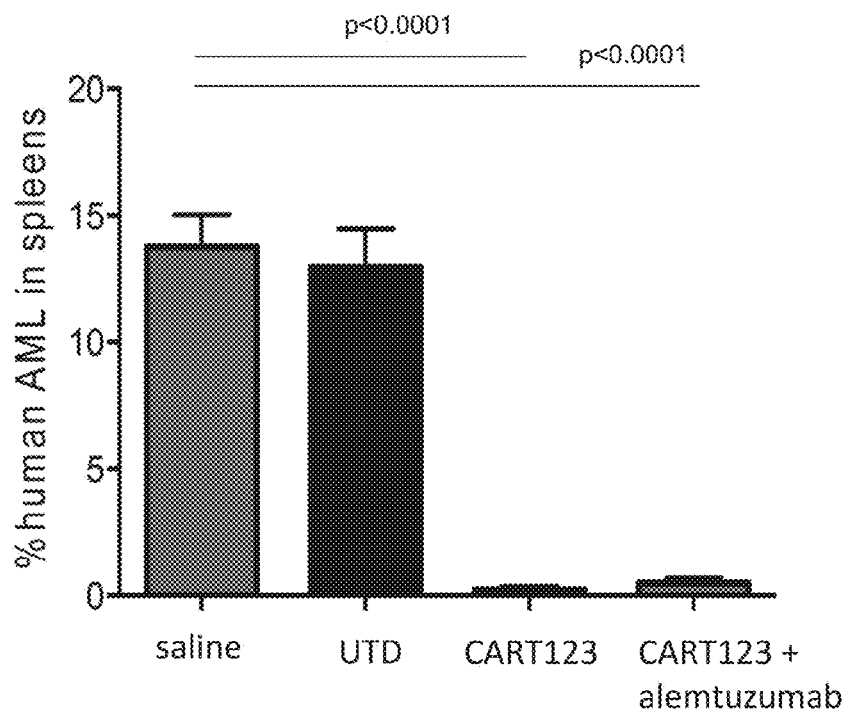
FIGS. 74A and 74B show the analysis of AML cells in the spleen (FIG. 74A) and the bone marrow (FIG. 74B) after CART123 and alemtuzumab treatment, as performed in FIGS. 73A-73B.
Figure 74B:
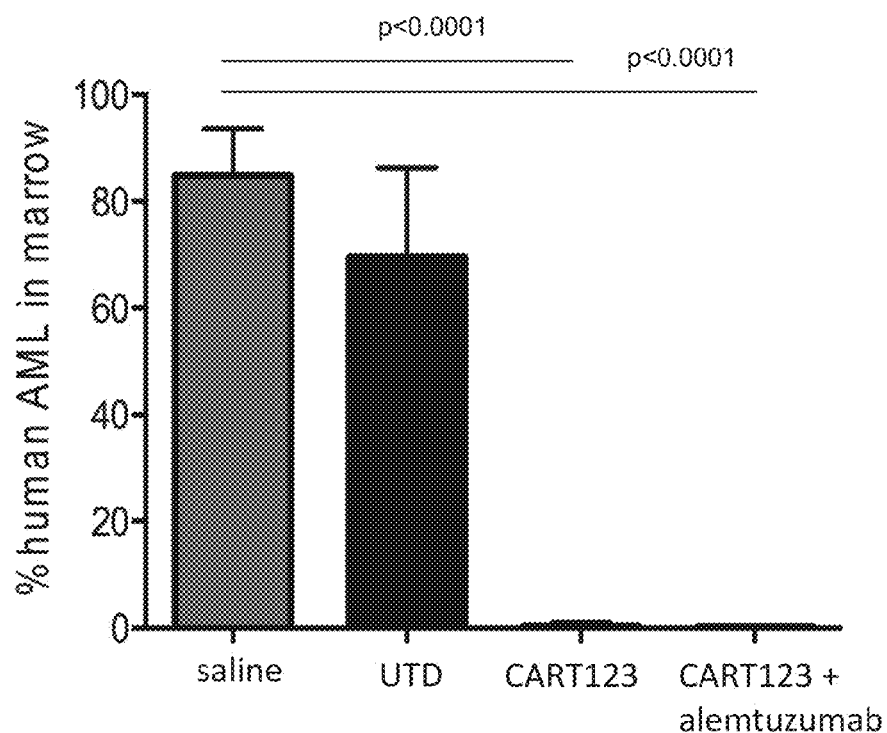

Alemtuzumab treatment was also examined in a second in vivo model, a pediatric patient-derived xenograft model. In this model, mice were injected with AML290 cells. Six weeks after AML engraftment, the mice were administered saline, untransduced T cells, or CART123 cells (represented at week 0). Alemtuzumab was administered at 5 mg/kg to a subset of the mice receiving CART123 cells at week 4. Alemtuzumab treatment was shown to completely eliminate CART123 T cells in the peripheral blood (FIG. 73B). Analysis of tumor progression showed that mice receiving CART123 demonstrated remission up to 8 weeks after CART123 treatment. Mice that received treatment of alemtuzumab and ablation of CART123 cells at week 4 remained in remission (FIG. 73A). Analysis of AML present in different organs of the xenografts after CART123 dosing was determined by flow cytometry. Treatment with CART123 cells resulted in ablation of AML cells in both the spleen (FIG. 74A) and bone marrow (FIG. 74B). Treatment with alemtuzumab 4 weeks after CART123 dosing preserved remission, as demonstrated by sustained ablation of AML cells in the spleen (FIG. 74A) and bone marrow (FIG. 74B).

RNA-CART123 most rapidly eliminated AML and facilitated long-term animal survival, although RNA-CART123 had expectedly shorter persistence in vivo than did CART123 or CART123/CD20. Alemtuzumab or rituximab alone did not inhibit AML proliferation in non-CART123-treated xenograft models vs AML-only controls (p=1.00).

Figure 75:
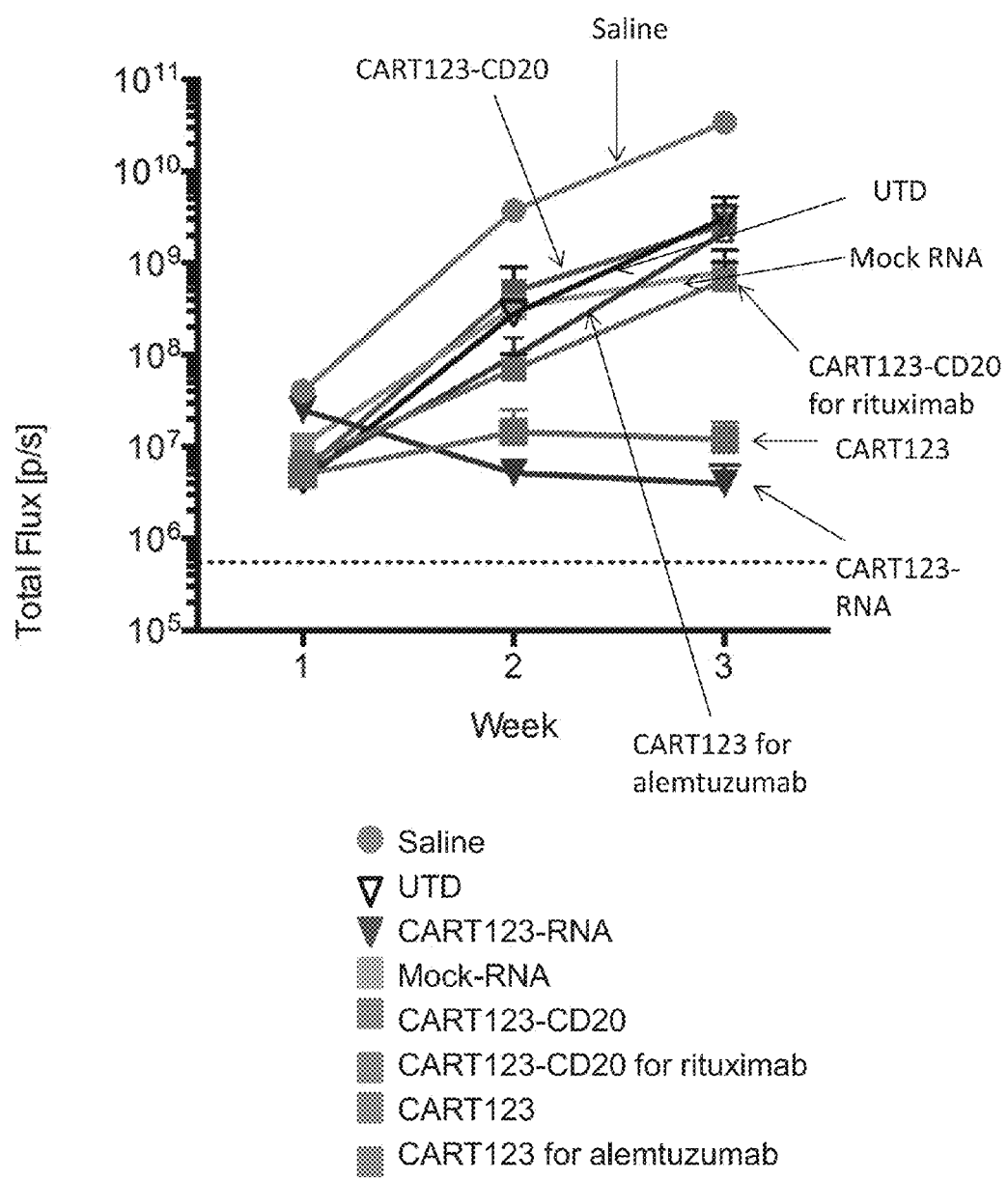
FIG. 75 shows the comparison of the three termination strategies: (1) CART cell ablation by alemtuzumab treatment; (2) CAR/CD20 co-expression in T cells and ablation by rituximab; and (3) RNA-electroporated CART cells, on tumor burden (represented by bioluminescent imaging; photons/sec) in the AML xenograft model.

Comparison of the three termination approaches described in this example is shown in FIG. 75.

Conclusions:

Alemtuzumab and rituximab completely eliminated CD123-redirected CAR T cells in human AML xenograft models. Sustained leukemia remission required CART123 or CART123/CD20 persistence for 4 weeks prior to T cell termination via alemtuzumab 5 mg/kg or rituximab 10 mg/kg post-CART123 or post-CART123/CD20, respectively. Ongoing studies are investigating efficacy of T cell elimination in additional primary AML xenograft models and against other anti-AML CAR T cell immunotherapies. These T cell termination strategies may augment efficacy of CAR T cell therapy in patients with AML, particularly prior to potential hematopoietic stem cell transplantation.

Example 13

CAR19 and CAR123 Combinations

Most of B-acute lymphoblastic leukemia (B-ALL) blasts co-express CD19 and CD123. Targeting both antigens at the same time can lead to increased anti-tumor activity and reduce the rate of relapse. As described in Example 8, the combination of CAR19 and CAR123 has increased therapeutic efficacy. In this example, different constructs for administering the combination of CAR19 and CAR123 are investigated.

Figure 63A:
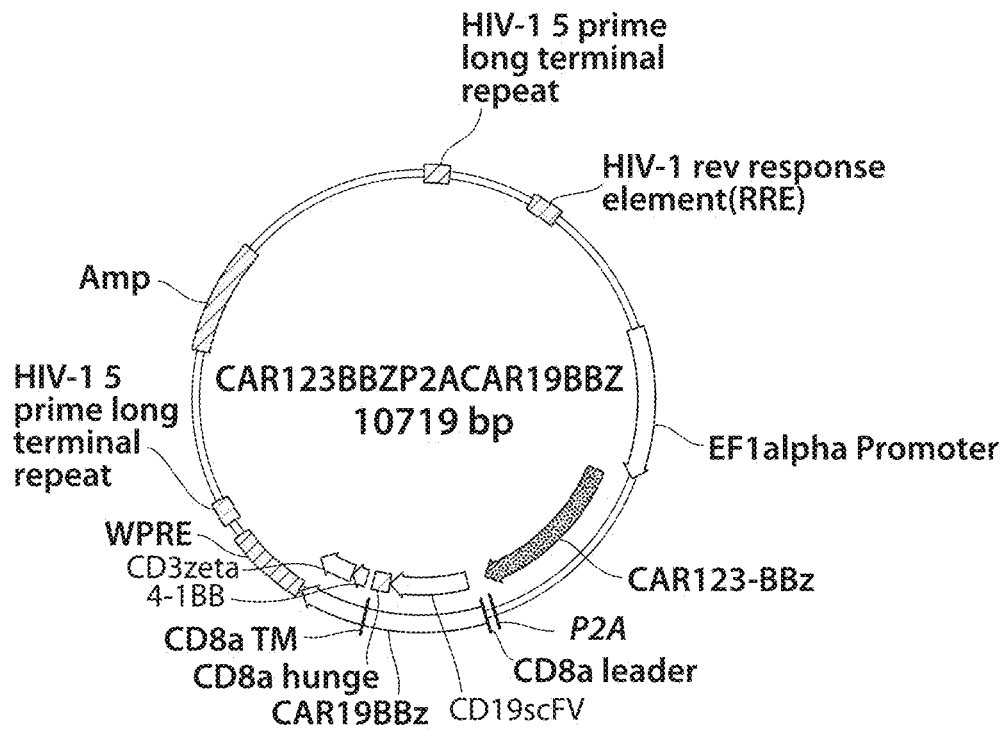
FIGS. 63A and 63B demonstrate the strategy for a dual CART cell expressing both a CAR19 and a CAR123.
Figure 63B:
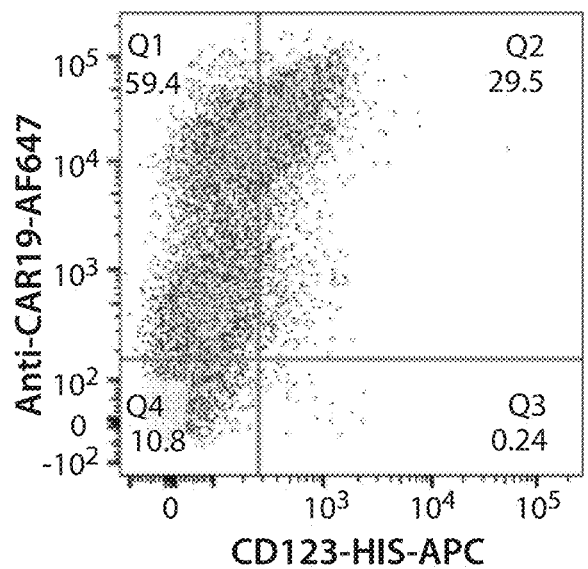

One strategy to administer the combination of CAR19 and CAR123 is through a dual CART, wherein a T cell expresses both the CAR19 and CAR123 constructs. A single lentiviral vector carrying the sequences of both CAR19 and CAR123 (instead of 2 separate vectors) was constructed to facilitate the dual-CART production for clinical use (FIG. 63A). This lentiviral construct includes both CAR19 and CAR123 linked through a P2A domain under the EF1 promoter. T cells were transduced with the lentiviral construct, cultured for 6 days, and then were stained with a CD19 scFv-specific antibody and CD123-His peptide and anti-His-PE antibody, for flow cytometry analysis. Results show that T cells expressing both CAR19 and CAR123 were detected (FIG. 63B).

Figure 64A:
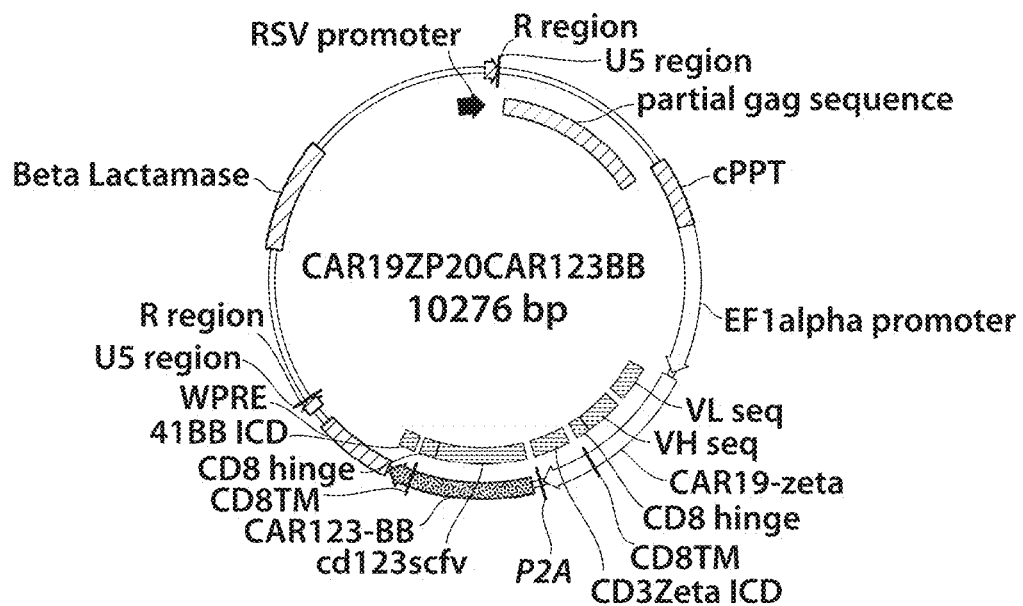
FIGS. 64A and 64B demonstrate the strategy for a split CART cell that expresses both a CAR19 and a CAR123.
Figure 64B:
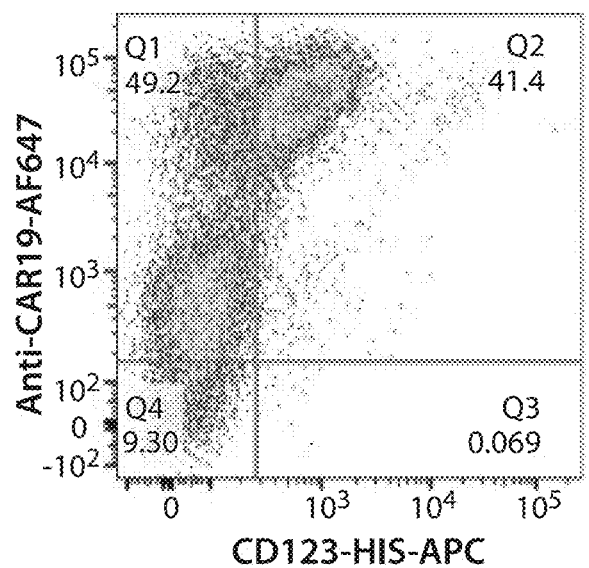

In another strategy, a split CAR strategy was utilized to express CAR19 and CAR123. In this strategy, a vector was constructed where a CAR123 comprising the costimulatory domain 4-1BB was linked through a P2A domain to a CAR19 comprising the primary signaling domain CD3zeta (FIG. 64A). Specifically, the CAR123 comprised a CD123 scFv, CD8 hinge and CD8 transmembrane domain, and the 4-1BB domain. The CAR19 comprised a CD19 scFv, CD8 hinge and CD8 transmembrane domain, and the CD3 zeta domain. In this strategy, only recognition of both CD19 and CD123 by the respective scFv portions of the CAR will result in activation of the split CART cell. T cells were transduced with the lentiviral construct, cultured for 6 days, and then were stained with a CD19 scFv-specific antibody and CD123-His peptide and anti-His-PE antibody, for flow cytometry analysis. Results show that T cells expressing both CAR19 and CAR123 were detected (FIG. 64B).

Example 14

CD123 CART Therapy in Histiocytic Disorders

CD123 CART therapy may be useful in histiocytic disorders, such as BPDCN or mast cell disorders. In this example, experiments were performed to assess CART123 function in the context of blastic plasmacytoid dendritic cell neoplasm (BPDCN) and mast cell disorders (such as systemic mastocytosis and mast cell leukemia).

BPDCN is a rare and aggressive hematologic neoplasm arising from the precursors of pDC, classified as a histiocyte/dendritic cell neoplasm. All BPDCN express CD123. CD123 appears to be critical for BPDCN survival as BPDCN blasts require IL-3 for successful ex vivo propagation. Despite initially high response rates to chemotherapy, long-term survival is usually very poor, and median survival is 9-13 months irrespective of initial presentation.

Figure 65:
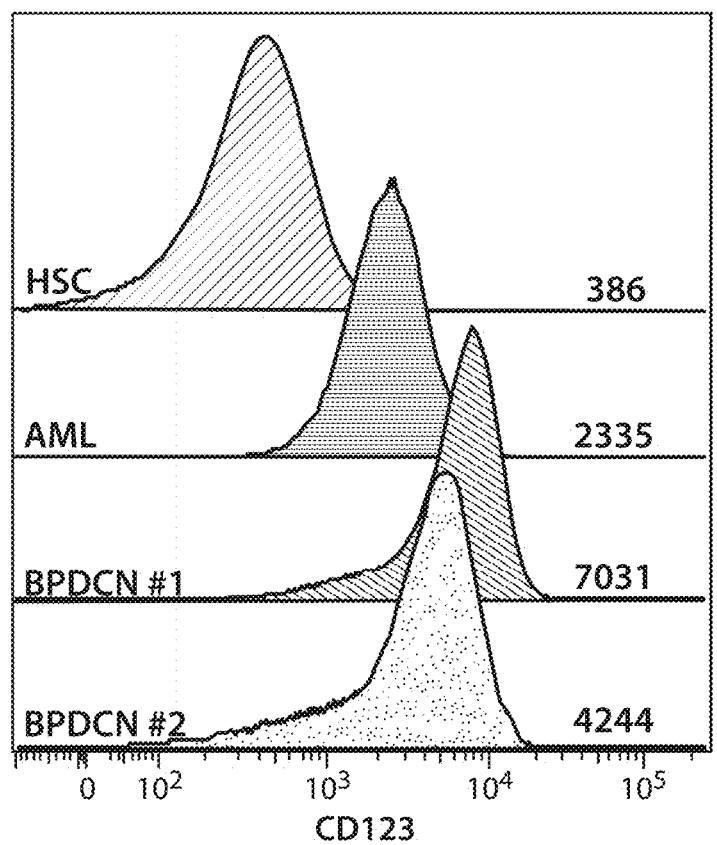
FIG. 65 shows the expression of CD123 on primary HSC, AML, and BPDCN samples.

CD123 expression was determined by flow cytometry on hematopoietic stem cells (HSC), acute myeloid leukemia cell line (AML), or two different BPDCN. Median fluorescence intensity is indicated. The expression of CD123 on AML, normal marrow CD34+ cells, and two cases of BPDCN are shown in FIG. 65. These data indicate that CD123 is expressed at 10-20-fold higher levels on BPDCN compared with normal marrow.

Figure 66A:
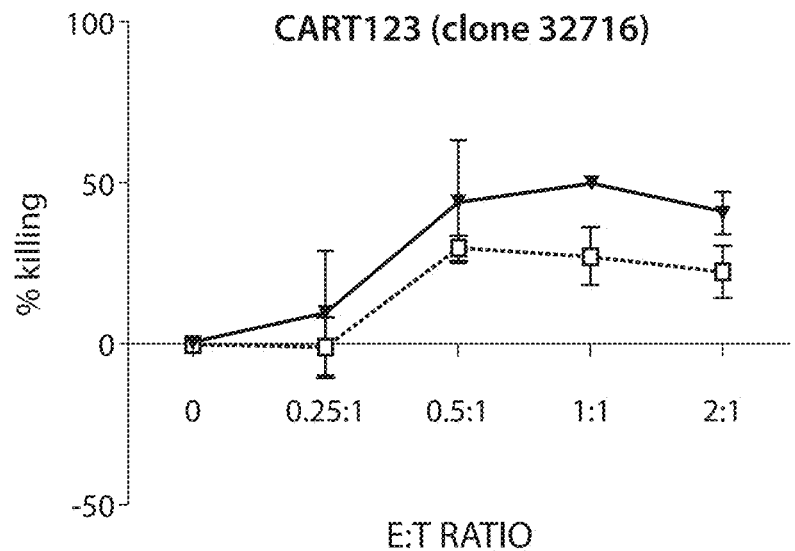
FIGS. 66A and 66B show a cytotoxicity assay for CART123 clones 32716 (FIG. 66A) and 26292 (FIG. 66A) when incubated in the presence of CD123-expressing target cells at the indicated effector:target ratios.
Figure 66B:
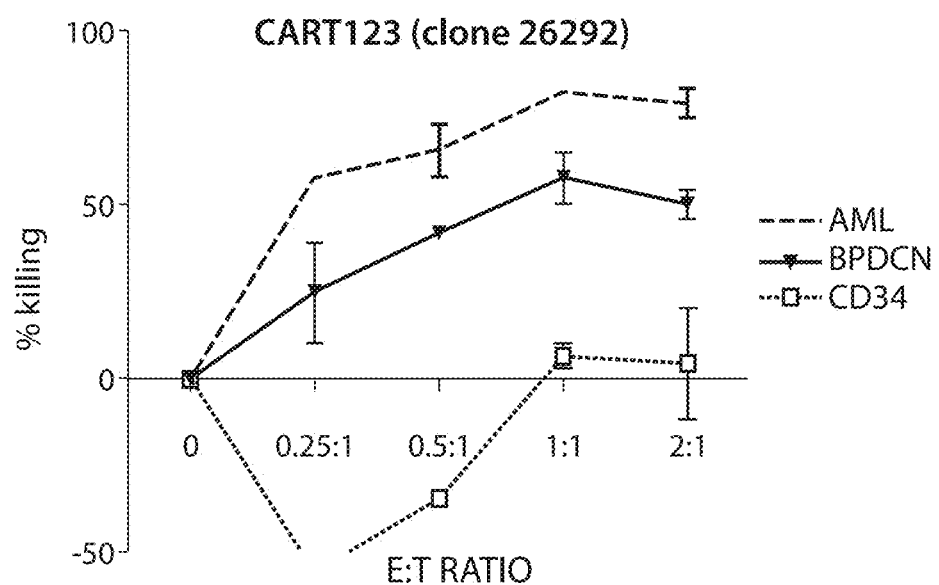

Additional CART123 constructs were generated using alternative anti-CD123 clones (32716 (also referred to herein as the 1172 construct) and 26292 (also referred to herein as the 1176 construct), both constructs are described and characterized in PCT/US2014/017328. Cell killing assays were performed similarly to those described in Example 2 or 3. Clone 26292 led to reduced killing of normal CD34 cells compared with positive control AML or BPDCN, indicating that it is feasible to produce CART-123 with attenuated activity that might generate an enhanced therapeutic window (FIG. 66B). In contrast, clone 32716 showed similar killing of CD34 cells and BPDCN (FIG. 66A).

Figure 67:
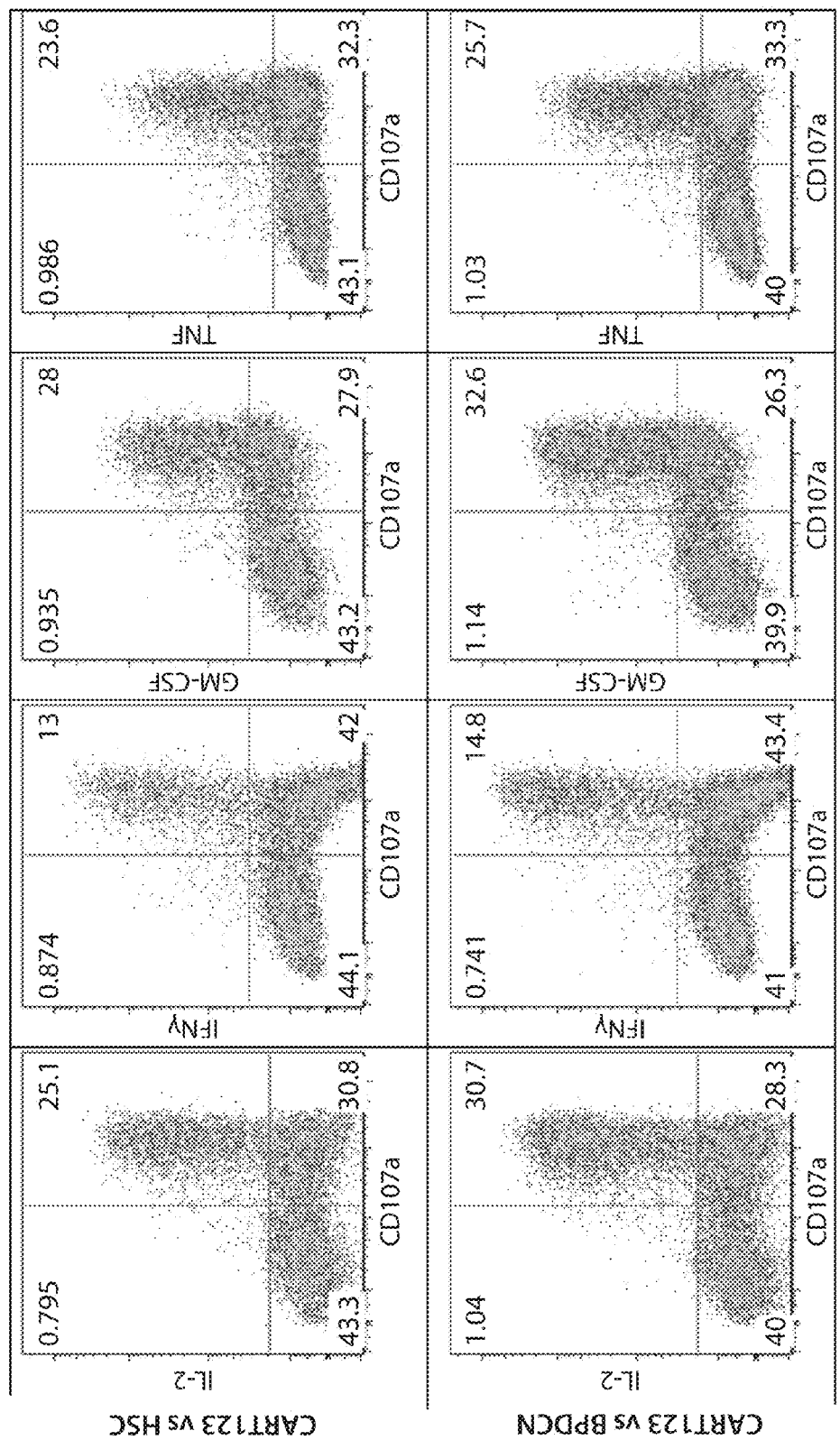
FIG. 67 shows a CD107 degranulation assay for CART123 cells when incubated with HSCs compared to BPDCN.

Sensitive analyses of T cell function such as degranulation and cytokine production were performed similarly to those described in Example 2 or 3. Clone 26292 CART123 were incubated with CD34+ HSC (FIG. 67, top row) or BPDCN (FIG. 67, bottom row) for four hours. CD107 degranulation was assessed. Results from the degranulation assay showed that effector functions of clone 26292 can still be triggered by CD34+HSC (FIG. 67, top row).

Mast cell disorders, including systemic mastocytosis and mast cell leukemia, are rare histiocytic malignancies that are associated with a poor prognosis. Mast cells express CD123 at high levels and thus mast cell disorders could be treated with CART123.

Analysis of CD123 expression on mast cell disorders was performed. Mononuclear cells from the blood of a patient with mast cell leukemia/systemic mastocytosis were stained with live/dead aqua (LDAQ, x axis in FIGS. 68A and 68B) and isotype (FIG. 68A) or CD123 PE (FIG. 68B). Most SM cells express CD123.

A CD107 degranulation assay was performed to assess CART123 activity in the presence of mast cell leukemia cells. CART123 cells were cultured alone, with PMA and ionomycin (FIG. 69A) or with mononuclear cells from the blood of a patient with mast cell leukemia/systemic mastocytosis (FIG. 69B) for two hours, in the presence of anti-CD107a antibody. T cells were gated using anti-CD3. CD107a positivity was gated using the CART123 alone tube. Response of CART123 to SM cells is equivalent to that generated with the positive control PMA+ionomycin.

Example 15

Effect of CART123 on the Tumor Microenvironment

In this example, assays are performed to test the effect of CD123 CAR-expressing cells on the tumor microenvironment. These assays can be used to assess the effect of CART123 on the tumor microenvironment in Hodgkin's Lymphoma.

A first assay is performed to determine whether malignant cells, e.g., Hodgkin Lymphoma cells (HL cells), lead to an immunosuppressive phenotype in cells in the tumor microenvironment, e.g., monocytes. Monocyte cells and HL cells are grown in a transwell plate comprising an upper and a lower chamber. The monocyte and malignant cells are cultured in the following configurations: (1) the monocyte cell is grown in one chamber, e.g., the lower chamber, and the HL cell is grown in the other chamber, e.g., the upper chamber, (2) the monocyte cell and HL cell are grown together in the same side of a transwell plate, or (3) the monocyte cell is grown alone (control). The cells are cultured for a desired period of time, and then the cells are harvested for flow cytometry analysis or real-time quantitative PCR to detect the monocyte phenotype, e.g., immunosuppressive phenotype, by assessing the levels of markers such as CD14 and HLADR.

A second assay is performed to determine whether the immunosuppressive tumor microenvironment cells, e.g., monocytes, can inhibit anti-tumor T cell immunity mediated by CART cells. This assay can be performed in two different ways, using a transwell plate if the inhibition of anti-tumor T cell immunity is suspected to be through a soluble factor, or using standard cell culture containers if the inhibition of anti-tumor T cell immunity is suspected to be contact-mediated. For an assay where inhibition of anti-tumor T cell immunity may be through a soluble factor, cells are grown in a transwell plate comprising an upper and a lower chamber. The cells are cultured in the following configurations: (1) a HL cell in one chamber, e.g., upper chamber, and a CART19 cell and a CD19-expressing tumor cell, e.g., a B cell tumor, in the other chamber, e.g., lower chamber; (2) a monocyte in one chamber, e.g., upper chamber, and a CART19 cell and a CD19-expressing tumor cell, e.g., a B cell tumor, in the other chamber; and (3) a HL cell and a monocyte in one chamber, e.g., upper chamber, and a CART19 cell and a CD19-expressing tumor cell, e.g., a B cell tumor, in the other chamber. For an assay where inhibition of anti-tumor T cell immunity may be contact-mediated, the cells are cultured in the following configurations: (1) a HL cell, a CART19 cell, and a CD19-expressing tumor cell; (2) a monocyte, a CART19 cell, and a CD19-expressing tumor cell; and (3) a HL cell, a monocyte, a CART19 cell, and a CD19-expressing tumor cell. The cells are cultured for a desired period of time, and then CART19 function is assessed. Assays to assess CART19 function include proliferation and killing assays, e.g., as described in Examples 2 and 3.

A third assay is performed to determine that CART123 targets immunosuppressive cells in the tumor microenvironment. This assay can be performed in two different ways, using a transwell plate if the inhibition of anti-tumor T cell immunity is suspected to be through a soluble factor, or using standard cell culture containers if the inhibition of anti-tumor T cell immunity is suspected to be contact-mediated. For an assay where inhibition of anti-tumor T cell immunity may be through a soluble factor, cells are grown in a transwell plate comprising an upper and a lower chamber. The cells are cultured in the three transwell plate configurations for the second assay described above, and in addition, are cultured in the following configurations which include the CART123 cell: (4) a HL cell and CART123 cell in one chamber, e.g., upper chamber, and a CART19 cell and a $CD19^+CD123^-$ tumor cell, e.g., a B cell tumor, in the other chamber, e.g., lower chamber; (5) a monocyte and CART123 cell in one chamber, e.g., upper chamber, and a CART19 cell and a $CD19^+CD123^-$ tumor cell, e.g., a B cell tumor, in the other chamber; and (6) a HL cell, a monocyte, and a CART123 cell in one chamber, e.g., upper chamber, and a CART19 cell and a $CD19^+CD123^-$ tumor cell, e.g., a B cell tumor, in the other chamber. For an assay where inhibition of anti-tumor T cell immunity may be contact-mediated, the cells are cultured in the three standard cell culture containers for the second assay described above, and in addition, are cultured in the following configurations which include the CART123 cell: (4) a HL cell, a CART19 cell, a CART123 cell, and a $CD19^+CD123^-$ tumor cell; (5) a monocyte, a CART19 cell, a CART123 cell, and a $CD19^+CD123^-$ tumor cell; and (6) a HL cell, a monocyte, a CART19 cell, a CART123 cell, and a $CD19^+CD123^-$ tumor cell. The cells are cultured for a desired period of time, and then CART19 function is assessed. Assays to assess CART19 function include proliferation and killing assays, e.g., as described in Examples 2 and 3.

Example 16

Clinical Study of RNA CART123 in Refractory or Relapsed AML

This study addresses the feasibility, safety and efficacy of intravenously administered, RNA electroporated autologous T cells expressing anti-CD123 chimeric antigen receptors expressing tandem TCRζ and 4-1BB (TCRζ/4-1BB) costimulatory domains (referred to as "RNA CART123") in Acute Myeloid Leukemia (AML) subjects. This study evaluates 15 subjects. Evaluable subjects are those who receive at least one dose of RNA CART123 cells. The duration of active protocol intervention is approximately 2 months from screening visit. Subjects are followed for 6 months after their first infusion.

The primary objectives of this study is to assess the safety of RNA CART123 in AML subjects by recording the frequency and severity of adverse events, including but not limited to, estimating the frequency of CRS (cytokine release syndrome) and MAS (macrophage activation syndrome). The secondary objectives of this study include: (1) determine persistence and trafficking of RNA CART123 cells; (2) estimate the efficacy of at least 1 dose of RNA CART123 cells in AML subjects by measuring reduction of blast counts in the peripheral blood and marrow; (3) Estimate the efficacy of at least 1 dose of RNA CART123 cells in AML subjects by measuring the overall response rate (ORR) at 28+/−5 days, using (i) standard morphologic complete response criteria (malignant blasts <5% with count recovery), (ii) malignant blasts <5% without count recovery, and (iii) minimal residual disease assessment; (4) determine overall survival (OS) and progression-free survival (PFS) and cause(s) of death for all subjects until 6 months post RNA CART123 cell infusion; (5) determine the duration of response (DOR) for responding subjects until 6 months post RNA CART123 cell infusion; and (6) determine the percentage of subjects proceeding to allogeneic HCT (or second allogeneic HCT).

Eligible subjects are male or female over 18 years old with AML or myelodysplastic syndrome with no available curative treatment options using currently available therapies. Subjects with second or subsequent relapse, any relapse refractory to salvage, or with persistent disease after at least two lines of therapy. Subjects must have evaluable disease >5% blasts on marrow aspirate or biopsy, or extramedullary disease (CNS involvement is prohibited) within 2 weeks prior to screening.

Figure 70:
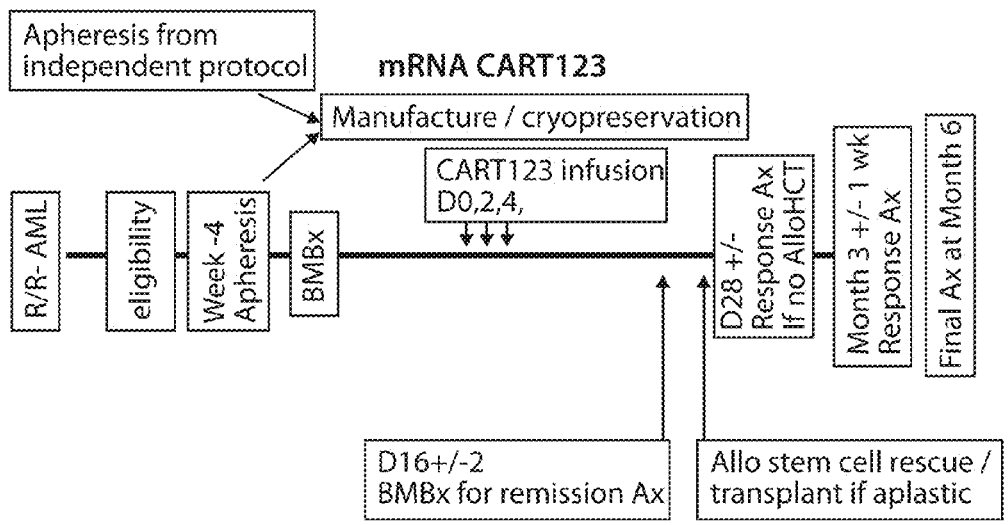
FIG. 70 shows the experimental schema for subject cohort 1 in a clinical study for administering RNA CART123 in subjects with refractory or relapsed AML.
Figure 71:
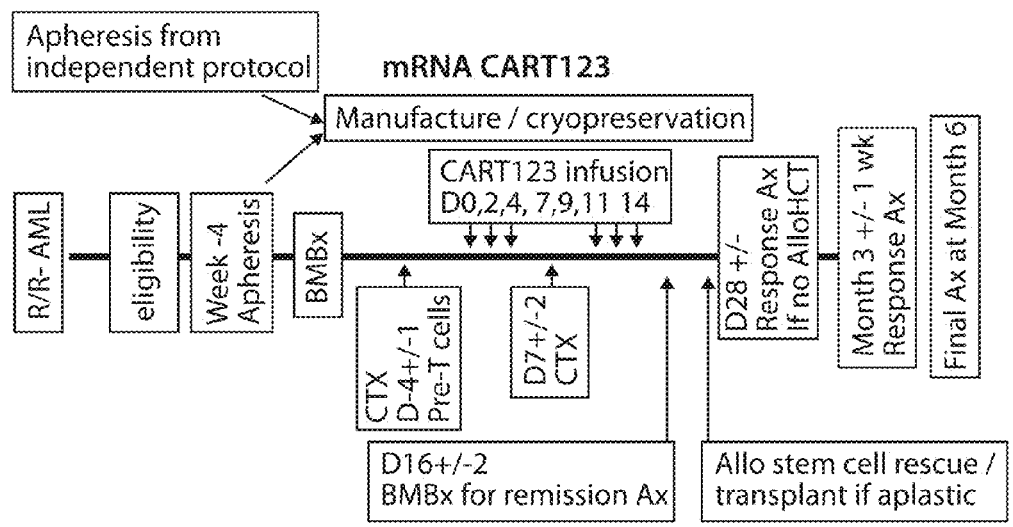
FIG. 71 shows the experimental schema for subject cohort 2 in a clinical study for administering RNA CART123 in subjects with refractory or relapsed AML. These patients receive doses of a lymphodepleting chemotherapy in addition to the CART therapy.

Subjects are treated with IV administration of RNA anti-CD123 CAR T cells for a total of up to six doses over 2 weeks. Dosing is according to subject weight with an in-subject dose escalation. Subjects are divided into two cohorts. Cohort 1 includes the first 3 subjects to receive RNA CART123 cells, and receives 3 escalating doses of RNA CART123 cells, with no lymphodepleting chemotherapy prior to infusion (FIG. 70). Cohort 2 includes remaining 12 subjects of the study, and receives up to six IV doses of RNA CART123 cells at an escalating dose (FIG. 71). Cohort 2 may be given lymphodepleting chemotherapy 4 days (+/−1 day) prior to the first CART123 cell infusion (if ALC>500/uL). Lymphodepleting chemotherapy may be repeated before the fourth dose of RNA CART123 cells (if ALC>500/uL). Lymphodepleting chemotherapy includes a single dose of cyclophosphamide (1 mg/m$^2$). The lymphodepleting chemotherapy dose within the RNA CART123 treatment regimen is designed to enhance engraftment of the subsequent T cell doses by enhancing homeostatic space.

The doses of CART cells by weight are provided in the table below:

| Subject weight | Dose 1 | Dose 2 | Doses 3-6 | Total CAR+ cells |
|---|---|---|---|---|
| <100 kg | $1 \times 10^6$/kg | $2 \times 10^6$/kg | $4 \times 10^6$/kg | $1.9 \times 10^7$/kg |
| ≥100 kg | $1 \times 10^8$ | $2 \times 10^8$ | $4 \times 10^8$ | $1.9 \times 10^9$ |

Weight used for dosing can be the weight obtained prior to the apheresis procedure. Cell numbers are based on CAR+ cells with CAR expression determined by flow cytometry. Dosing will not be changed for changes in subject weight. The indicated doses are +/−20% to account for manufacturing variability.

A sample RNA CART123 dosing schedule is provided below:

| Day 0 infusion occurs on: | Study Days of subsequent infusions: | Study Day of mid-treatment cyclophosphamide (Cohort 2), if given |
|---|---|---|
| Monday | D 2, D 4, D 9*, D 11*, D 14* | D 7 |
| | D 2, D 4, D 7*, D 9*, D 11* | No |
| Wednesday | D 2, D 5, D 9*, D 12*, D 14* | D 7 |
| | D 2, D 5, D 7*, D 9*, D 11* | No |
| Friday | D 3, D 5, D 10*, D 12*, D 14* | D 7 |
| | D 3, D 5, D 7*, D 10*, D 12* | No |

*Infusions for subjects in Cohort 2 only

Baseline and subsequent tumor assessments will be performed according to standard of care clinical practice for AML. Baseline AML marrow assessment can be performed if the subject's last marrow was performed more than 2 weeks prior to the first cyclophosphamide dose. Subjects will have marrow assessment for leukemia response at Day 16+/−2 (or within 7 days of the last RNA CART123 infusion received), Day 28+/−5, and at both 3 and 6 months (for subjects who did not proceed to an alloHCT). CART cell levels and cytokines will be determined by the appropriate test at the TCSL research laboratory. Disease response definitions can be as standard for AML.

All subjects with marrow aplasia at D28+/−5 (or 14 days after the last T cell infusion, whichever occurs earlier) will undergo allogeneic hematopoietic cell transplantation (alloHCT) as a rescue strategy. All subjects should therefore have a previously identified stem cell donor. Marrow aplasia is defined as >75% reduction in cellularity from normal for age, in conjunction with ANC <0.5 k/ul or platelets <50 k/ul.

Treatment limiting toxicity (TLT) is defined as any unexpected event that is possibly, probably, or definitely related to the T cell infusion, including non-hematological grade 3 or greater adverse event and any Grade 3 or greater hypersensitivity reaction and autoimmune reaction as defined in Section 5.5. The following events do not comprise TLT: fever and infection, cytopenias of any grade, tumor lysis syndrome, cytokine release syndrome or any metabolic or laboratory abnormalities that resolve to Grade 2 or lower within seven days.

Adverse event reporting begins at the start of the first dose of RNA CART123 cells and will continue through Month 4 or until conditioning for HCT or another alternative therapy is initiated, whichever occurs earlier. Subjects can be continually reassessed for evidence of acute and cumulative toxicity.

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (709 sequences)

SEQ ID NO: 1 - protein, 21 aa, Homo sapiens
MALPVTALLLPLALLLHAARP

SEQ ID NO: 2 - protein, 45 aa, Homo sapiens
TTTPAPRPPTPAPTIASQPLSLRPEACRPAAGGAVHTRGLDFACD

SEQ ID NO: 3 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 4 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 5 - protein, 10 aa, Artificial Sequence
  source: /note="Description of Artificial Sequence: Synthetic peptide"
GGGGSGGGGS

SEQ ID NO: 6 - protein, 24 aa, Homo sapiens
IYIWAPLAGTCGVLLLSLVITLYC

SEQ ID NO: 7 - protein, 42 aa, Homo sapiens
KRGRKKLLYIFKQPFMRPVQTTQEEDGCSCRFPEEEEGGCEL

SEQ ID NO: 8 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 9 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 12 - DNA, 63 bp, Homo sapiens
atggccctgcctgtgacagccctgctgctgcctctggctctgctgctgcatgccgctagaccc

SEQ ID NO: 13 - DNA, 135 bp, Homo sapiens
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 14 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 15 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 16 - DNA, 30 bp, Artificial Sequence
  source: /note="Description of Artificial Sequence: Synthetic oligonucleotide"
ggtggcggaggttctggaggtggaggttcc

SEQ ID NO: 17 - DNA, 72 bp, Homo sapiens
atctacatctgggcgcccttggccgggacttgtggggtccttctcctgtcactggttatcaccctttactgc

SEQ ID NO: 18 - DNA, 126 bp, Homo sapiens
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 19 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 20 - DNA, 336 bp, Homo sapiens
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 21 - DNA, 336 bp, Homo sapiens
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 23 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 24 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 25 - protein, 5 aa, Artificial Sequence
  source: /note="Description of Artificial Sequence: Synthetic peptide"
  MISC_FEATURE (1)..(5): /note="See specification as filed for detailed description of substitutions and preferred embodiments"
GGGGS

SEQ ID NO: 26 - protein, 30 aa, Artificial Sequence
  source: /note="Description of Artificial Sequence: Synthetic polypeptide"
  MISC_FEATURE (1)..(30): /note="This sequence may encompass 1-6 "Gly Gly Gly Gly Ser" repeating units"
GGGGSGGGGSGGGGSGGGGSGGGGSGGGGS

SEQ ID NO: 27 - protein, 20 aa, Artificial Sequence
  source: /note="Description of Artificial Sequence: Synthetic peptide"
GGGGSGGGGSGGGGSGGGGS

SEQ ID NO: 28 - protein, 15 aa, Artificial Sequence
  source: /note="Description of Artificial Sequence: Synthetic peptide"
GGGGSGGGGSGGGGS

SEQ ID NO: 29 - protein, 4 aa, Artificial Sequence
  source: /note="Description of Artificial Sequence: Synthetic peptide"
GGGS

SEQ ID NO: 30 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 32 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 33 - DNA, 5000 bp, Artificial Sequence; identical to SEQ ID NO: 30
  source: /note="Description of Artificial Sequence: Synthetic polynucleotide"
  misc_feature (1)..(5000): /note="This sequence may encompass 100-5000 nucleotides"

SEQ ID NO: 34 - DNA, 400 bp, Artificial Sequence
  source: /note="Description of Artificial Sequence: Synthetic polynucleotide"
  misc_feature (1)..(400): /note="This sequence may encompass 100-400 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 36 - protein, 230 aa, Homo sapiens; identical to SEQ ID NO: 3

SEQ ID NO: 37 - DNA, 690 bp, Homo sapiens; identical to SEQ ID NO: 14

SEQ ID NO: 38 - protein, 4 aa, Artificial Sequence
  source: /note="Description of Artificial Sequence: Synthetic peptide"
  MISC_FEATURE (1)..(4): /note="See specification as filed for detailed description of substitutions and preferred embodiments"
GGGS

SEQ ID NO: 39 - DNA, 1461 bp, Homo sapiens
atggccctccctgtcaccgccctgctgcttccgctggctcttctgctccacgccgctcggccccaagtccaactcgtccagtcaggagcggaagtcaagaagcccggagcgtcagtcaaagtgtcatgcaaagcctcgggctacactttcactgggtactacatgcactgggtgcgccaggctccaggacagggactggaatggatgggatggatcaacccgaactccggtggcaccaattacgcccagaagttccaggggagggtgaccatgactcgcgacacgtcgatcagcaccgcatacatggagctgtcaagactccggtccgacgatactgccgtgtactactgcgcacgggacatgaacattctggccaccgtgccttttgacatctggggtcagggaactatggttaccgtgtcctctggtggaggcggctccggcggggggggaagcggaggcggtggaagcgacattcagatgacccagtcgccttcatccctttcggcgagcgtgggagatcgcgtcactatcacttgtcgggcctcgcagtccatctccacctacctcaattggtaccagcagaagccaggaaaagcaccgaatctgctgatctacgccgcgttttccttgcaatcgggagtgccaagcagattcagcggatcgggatcaggcactgatttcaccctcaccatcaactcgctgcaaccggaggatttcgctacgtactattgccaacaaggagacagcgtgccgctcaccttcggcggagggactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 40 - DNA, 1461 bp, Homo sapiens
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 41 - DNA, 1461 bp, Homo sapiens
atggccctccctgtcaccgccctgctgcttccgctggctcttctgctccacgccgctcggccccaagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 42 - DNA, 1467 bp, Homo sapiens
atggccctccctgtcaccgccctgctgcttccgctggctcttctgctccacgccgctcggccccaagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 43 - protein, 41 aa, Artificial Sequence
  source: /note="Description of Artificial Sequence: Synthetic polypeptide"
RSKRSRLLHSDYMNMTPRRPGPTRKHYQPYAPPRDFAAYRS

SEQ ID NO: 44 - DNA, 123 bp, Artificial Sequence; identical to SEQ ID NO: 19
  source: /note="Description of Artificial Sequence: Synthetic polynucleotide"

SEQ ID NO: 45 - protein, 35 aa, Artificial Sequence
  source: /note="Description of Artificial Sequence: Synthetic polypeptide"
TKKKYSSSVHDPNGEYMFMRAVNTAKKSRLTDVTL

SEQ ID NO: 46 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 47 - protein, 9 aa, Artificial Sequence
  source: /note="Description of Artificial Sequence: Synthetic peptide"
QQHNKYPYT

SEQ ID NO: 48 - DNA, 134 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtga

SEQ ID NO: 49-63 - skipped (15 entries)

SEQ ID NO: 64 - protein, 30 aa, Artificial Sequence; identical to SEQ ID NO: 26
  source: /note="Description of Artificial Sequence: Synthetic polypeptide"
  MISC_FEATURE (1)..(30): /note="This sequence may encompass 1-6 "Gly Gly Gly Gly Ser" repeating units"

SEQ ID NO: 65 - skipped

SEQ ID NO: 66 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 67 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 68 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 69 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 70 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 71 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 72 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 73 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 74 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 75 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 76 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 77 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 78 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 79 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 80 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 81 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 82 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 83 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 84 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 85 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 86 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 87 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 88 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 89 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 90 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 91 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 92 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 93 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 94 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 95 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 96 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 97 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 98 - protein, 487 aa, Homo sapiens
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 99 - protein, 487 aa, Homo sapiens
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 100 - protein, 487 aa, Homo sapiens
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 101 - protein, 336 aa, Homo sapiens
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 102-124 - skipped (23 entries)

SEQ ID NO: 125 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 126 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 127 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 128 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 129 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 131 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 132 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 133 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 135 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 136 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 137 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 139 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 140 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 141 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 143 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 144 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 145 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 147 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 148 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 149 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 150 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 151 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 152 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 153 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 154 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 155 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 156 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 157 - protein, 264 aa, Homo sapiens
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 158 - protein, 264 aa, Homo sapiens
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 159 - protein, 264 aa, Homo sapiens
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 160 - protein, 266 aa, Homo sapiens
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 161-183 - skipped (23 entries)

SEQ ID NO: 184 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 185 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 186 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 187 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 188 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 189 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 190 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 191 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 192 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 193 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 194 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 195 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 196 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 197 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 198 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 199 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 200 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 201 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 202 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 203 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 204 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 205 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 206 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 207 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 208 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 209 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 210 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 211 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 212 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 213 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 214 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 215 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 216 - protein, 121 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSS

SEQ ID NO: 217 - protein, 121 aa, Homo sapiens
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSS

SEQ ID NO: 218 - protein, 121 aa, Homo sapiens
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSS

SEQ ID NO: 219 - protein, 121 aa, Homo sapiens
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS

SEQ ID NO: 220-242 - skipped (23 entries)

SEQ ID NO: 243 - protein, 115 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 244 - protein, 115 aa, Artificial Sequence; identical to SEQ ID NO: 243
  source: /note="Description of Artificial Sequence: Synthetic polypeptide"

SEQ ID NO: 245 - protein, 115 aa, Artificial Sequence; identical to SEQ ID NO: 243
  source: /note="Description of Artificial Sequence: Synthetic polypeptide"

SEQ ID NO: 246 - protein, 115 aa, Artificial Sequence; identical to SEQ ID NO: 243
  source: /note="Description of Artificial Sequence: Synthetic polypeptide"

SEQ ID NO: 247 - protein, 115 aa, Artificial Sequence; identical to SEQ ID NO: 243
  source: /note="Description of Artificial Sequence: Synthetic polypeptide"

SEQ ID NO: 248 - protein, 115 aa, Artificial Sequence; identical to SEQ ID NO: 243
  source: /note="Description of Artificial Sequence: Synthetic polypeptide"

SEQ ID NO: 249 - protein, 115 aa, Artificial Sequence; identical to SEQ ID NO: 243
  source: /note="Description of Artificial Sequence: Synthetic polypeptide"

SEQ ID NO: 250 - protein, 115 aa, Artificial Sequence; identical to SEQ ID NO: 243
  source: /note="Description of Artificial Sequence: Synthetic polypeptide"

SEQ ID NO: 251 - protein, 115 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 252 - protein, 115 aa, Artificial Sequence; identical to SEQ ID NO: 251
  source: /note="Description of Artificial Sequence: Synthetic polypeptide"

SEQ ID NO: 253 - protein, 115 aa, Artificial Sequence; identical to SEQ ID NO: 251
  source: /note="Description of Artificial Sequence: Synthetic polypeptide"

SEQ ID NO: 254 - protein, 115 aa, Artificial Sequence; identical to SEQ ID NO: 251
  source: /note="Description of Artificial Sequence: Synthetic polypeptide"

SEQ ID NO: 255 - protein, 115 aa, Artificial Sequence; identical to SEQ ID NO: 251
  source: /note="Description of Artificial Sequence: Synthetic polypeptide"

SEQ ID NO: 256 - protein, 115 aa, Artificial Sequence; identical to SEQ ID NO: 251
  source: /note="Description of Artificial Sequence: Synthetic polypeptide"

SEQ ID NO: 257 - protein, 115 aa, Artificial Sequence; identical to SEQ ID NO: 251
  source: /note="Description of Artificial Sequence: Synthetic polypeptide"

SEQ ID NO: 258 - protein, 115 aa, Artificial Sequence; identical to SEQ ID NO: 251
  source: /note="Description of Artificial Sequence: Synthetic polypeptide"

SEQ ID NO: 259 - protein, 115 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 260 - protein, 115 aa, Artificial Sequence; identical to SEQ ID NO: 259
  source: /note="Description of Artificial Sequence: Synthetic polypeptide"

SEQ ID NO: 261 - protein, 115 aa, Artificial Sequence; identical to SEQ ID NO: 259
  source: /note="Description of Artificial Sequence: Synthetic polypeptide"

SEQ ID NO: 262 - protein, 115 aa, Artificial Sequence; identical to SEQ ID NO: 259
  source: /note="Description of Artificial Sequence: Synthetic polypeptide"

SEQ ID NO: 263 - protein, 115 aa, Artificial Sequence; identical to SEQ ID NO: 259
  source: /note="Description of Artificial Sequence: Synthetic polypeptide"

SEQ ID NO: 264 - protein, 115 aa, Artificial Sequence; identical to SEQ ID NO: 259
  source: /note="Description of Artificial Sequence: Synthetic polypeptide"

SEQ ID NO: 265 - protein, 115 aa, Artificial Sequence; identical to SEQ ID NO: 259
  source: /note="Description of Artificial Sequence: Synthetic polypeptide"

SEQ ID NO: 266 - protein, 115 aa, Artificial Sequence; identical to SEQ ID NO: 259
  source: /note="Description of Artificial Sequence: Synthetic polypeptide"

SEQ ID NO: 267 - protein, 115 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 268 - protein, 115 aa, Artificial Sequence; identical to SEQ ID NO: 267
  source: /note="Description of Artificial Sequence: Synthetic polypeptide"

SEQ ID NO: 269 - protein, 115 aa, Artificial Sequence; identical to SEQ ID NO: 267
  source: /note="Description of Artificial Sequence: Synthetic polypeptide"

SEQ ID NO: 270 - protein, 115 aa, Artificial Sequence; identical to SEQ ID NO: 267
  source: /note="Description of Artificial Sequence: Synthetic polypeptide"

SEQ ID NO: 271 - protein, 115 aa, Artificial Sequence; identical to SEQ ID NO: 267
  source: /note="Description of Artificial Sequence: Synthetic polypeptide"

SEQ ID NO: 272 - protein, 115 aa, Artificial Sequence; identical to SEQ ID NO: 267
  source: /note="Description of Artificial Sequence: Synthetic polypeptide"

SEQ ID NO: 273 - protein, 115 aa, Artificial Sequence; identical to SEQ ID NO: 267
  source: /note="Description of Artificial Sequence: Synthetic polypeptide"

SEQ ID NO: 274 - protein, 115 aa, Artificial Sequence; identical to SEQ ID NO: 267
  source: /note="Description of Artificial Sequence: Synthetic polypeptide"

SEQ ID NO: 275 - protein, 107 aa, Homo sapiens
DIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 276 - protein, 107 aa, Homo sapiens
DIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 277 - protein, 107 aa, Homo sapiens
DIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 278 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 279-301 - skipped (23 entries)

SEQ ID NO: 302 - protein, 107 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 303 - protein, 107 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 304 - protein, 107 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 305 - protein, 107 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 306 - protein, 107 aa, Artificial Sequence; identical to SEQ ID NO: 302
  source: /note="Description of Artificial Sequence: Synthetic polypeptide"

SEQ ID NO: 307 - protein, 107 aa, Artificial Sequence; identical to SEQ ID NO: 303
  source: /note="Description of Artificial Sequence: Synthetic polypeptide"

SEQ ID NO: 308 - protein, 107 aa, Artificial Sequence; identical to SEQ ID NO: 304
  source: /note="Description of Artificial Sequence: Synthetic polypeptide"

SEQ ID NO: 309 - protein, 107 aa, Artificial Sequence; identical to SEQ ID NO: 305
  source: /note="Description of Artificial Sequence: Synthetic polypeptide"

SEQ ID NO: 310 - protein, 107 aa, Artificial Sequence; identical to SEQ ID NO: 302
  source: /note="Description of Artificial Sequence: Synthetic polypeptide"

SEQ ID NO: 311 - protein, 107 aa, Artificial Sequence; identical to SEQ ID NO: 303
  source: /note="Description of Artificial Sequence: Synthetic polypeptide"

SEQ ID NO: 312 - protein, 107 aa, Artificial Sequence; identical to SEQ ID NO: 304
  source: /note="Description of Artificial Sequence: Synthetic polypeptide"

SEQ ID NO: 313 - protein, 107 aa, Artificial Sequence; identical to SEQ ID NO: 305
  source: /note="Description of Artificial Sequence: Synthetic polypeptide"

SEQ ID NO: 314 - protein, 107 aa, Artificial Sequence; identical to SEQ ID NO: 302
  source: /note="Description of Artificial Sequence: Synthetic polypeptide"

SEQ ID NO: 315 - protein, 107 aa, Artificial Sequence; identical to SEQ ID NO: 303
  source: /note="Description of Artificial Sequence: Synthetic polypeptide"

SEQ ID NO: 316 - protein, 107 aa, Artificial Sequence; identical to SEQ ID NO: 304
  source: /note="Description of Artificial Sequence: Synthetic polypeptide"

SEQ ID NO: 317 - protein, 107 aa, Artificial Sequence; identical to SEQ ID NO: 305
  source: /note="Description of Artificial Sequence: Synthetic polypeptide"

SEQ ID NO: 318 - protein, 107 aa, Artificial Sequence; identical to SEQ ID NO: 302
  source: /note="Description of Artificial Sequence: Synthetic polypeptide"

SEQ ID NO: 319 - protein, 107 aa, Artificial Sequence; identical to SEQ ID NO: 303
  source: /note="Description of Artificial Sequence: Synthetic polypeptide"

SEQ ID NO: 320 - protein, 107 aa, Artificial Sequence; identical to SEQ ID NO: 304
  source: /note="Description of Artificial Sequence: Synthetic polypeptide"

SEQ ID NO: 321 - protein, 107 aa, Artificial Sequence; identical to SEQ ID NO: 305
  source: /note="Description of Artificial Sequence: Synthetic polypeptide"

SEQ ID NO: 322 - protein, 107 aa, Artificial Sequence; identical to SEQ ID NO: 302
  source: /note="Description of Artificial Sequence: Synthetic polypeptide"

SEQ ID NO: 323 - protein, 107 aa, Artificial Sequence; identical to SEQ ID NO: 303
  source: /note="Description of Artificial Sequence: Synthetic polypeptide"

SEQ ID NO: 324 - protein, 107 aa, Artificial Sequence; identical to SEQ ID NO: 304
  source: /note="Description of Artificial Sequence: Synthetic polypeptide"

SEQ ID NO: 325 - protein, 107 aa, Artificial Sequence; identical to SEQ ID NO: 305
  source: /note="Description of Artificial Sequence: Synthetic polypeptide"

SEQ ID NO: 326 - protein, 107 aa, Artificial Sequence; identical to SEQ ID NO: 302
  source: /note="Description of Artificial Sequence: Synthetic polypeptide"

SEQ ID NO: 327 - protein, 107 aa, Artificial Sequence; identical to SEQ ID NO: 303
  source: /note="Description of Artificial Sequence: Synthetic polypeptide"

SEQ ID NO: 328 - protein, 107 aa, Artificial Sequence; identical to SEQ ID NO: 304
  source: /note="Description of Artificial Sequence: Synthetic polypeptide"

SEQ ID NO: 329 - protein, 107 aa, Artificial Sequence; identical to SEQ ID NO: 305
  source: /note="Description of Artificial Sequence: Synthetic polypeptide"

SEQ ID NO: 330 - protein, 107 aa, Artificial Sequence; identical to SEQ ID NO: 302
  source: /note="Description of Artificial Sequence: Synthetic polypeptide"

SEQ ID NO: 331 - protein, 107 aa, Artificial Sequence; identical to SEQ ID NO: 303
  source: /note="Description of Artificial Sequence: Synthetic polypeptide"

SEQ ID NO: 332 - protein, 107 aa, Artificial Sequence; identical to SEQ ID NO: 304
  source: /note="Description of Artificial Sequence: Synthetic polypeptide"

SEQ ID NO: 333 - protein, 107 aa, Artificial Sequence; identical to SEQ ID NO: 305
  source: /note="Description of Artificial Sequence: Synthetic polypeptide"

SEQ ID NO: 334 - protein, 10 aa, Artificial Sequence
  source: /note="Description of Artificial Sequence: Synthetic peptide"
GYTFTDYYMH

SEQ ID NO: 335 - protein, 10 aa, Artificial Sequence
  source: /note="Description of Artificial Sequence: Synthetic peptide"
GYTFTGYYMH

SEQ ID NO: 336 - protein, 10 aa, Artificial Sequence
  source: /note="Description of Artificial Sequence: Synthetic peptide"
GYTFTGYYMH

SEQ ID NO: 337 - protein, 10 aa, Artificial Sequence
  source: /note="Description of Artificial Sequence: Synthetic peptide"
GYIFTGYYIH

SEQ ID NO: 338-360 - skipped (23 entries)

SEQ ID NO: 361 - protein, 10 aa, Artificial Sequence
  source: /note="Description of Artificial Sequence: Synthetic peptide"
GYTFTSYWMN

SEQ ID NO: 362 - protein, 17 aa, Artificial Sequence
  source: /note="Description of Artificial Sequence: Synthetic peptide"
WINPNSGDTNYAQKFQG

SEQ ID NO: 363 - protein, 17 aa, Artificial Sequence
  source: /note="Description of Artificial Sequence: Synthetic peptide"
WINPNSGGTNYAQKFQG

SEQ ID NO: 364 - protein, 17 aa, Artificial Sequence
  source: /note="Description of Artificial Sequence: Synthetic peptide"
WINPNSGGTNYAQKFQG

SEQ ID NO: 365 - protein, 17 aa, Artificial Sequence
  source: /note="Description of Artificial Sequence: Synthetic peptide"
WINPNSGGTNYAQKFQG

SEQ ID NO: 366-388 - skipped (23 entries)

SEQ ID NO: 389 - protein, 17 aa, Artificial Sequence
  source: /note="Description of Artificial Sequence: Synthetic peptide"
RIDPYDSETHYNQKFKD

SEQ ID NO: 390 - protein, 12 aa, Artificial Sequence
  source: /note="Description of Artificial Sequence: Synthetic peptide"
DMNILATVPFDI

SEQ ID NO: 391 - protein, 12 aa, Artificial Sequence
  source: /note="Description of Artificial Sequence: Synthetic peptide"
DMNILATVPFDI

SEQ ID NO: 392 - protein, 12 aa, Artificial Sequence
  source: /note="Description of Artificial Sequence: Synthetic peptide"
DMNILATVPFDI

SEQ ID NO: 393 - protein, 12 aa, Artificial Sequence
  source: /note="Description of Artificial Sequence: Synthetic peptide"
DMNILATVPFDI

SEQ ID NO: 394-416 - skipped (23 entries)

SEQ ID NO: 417 - protein, 6 aa, Artificial Sequence
  source: /note="Description of Artificial Sequence: Synthetic peptide"
GNWDDY

SEQ ID NO: 418 - protein, 11 aa, Artificial Sequence
  source: /note="Description of Artificial Sequence: Synthetic peptide"
RASQSISTYLN

SEQ ID NO: 419 - protein, 11 aa, Artificial Sequence
  source: /note="Description of Artificial Sequence: Synthetic peptide"
RASQSISSYLN

SEQ ID NO: 420 - protein, 11 aa, Artificial Sequence
  source: /note="Description of Artificial Sequence: Synthetic peptide"
RASQSISSYLN

SEQ ID NO: 421 - protein, 11 aa, Artificial Sequence
  source: /note="Description of Artificial Sequence: Synthetic peptide"
RASQSISSYLN

SEQ ID NO: 422-444 - skipped (23 entries)

SEQ ID NO: 445 - protein, 11 aa, Artificial Sequence
  source: /note="Description of Artificial Sequence: Synthetic peptide"
RASKSISKDLA

SEQ ID NO: 446 - protein, 7 aa, Artificial Sequence
  source: /note="Description of Artificial Sequence: Synthetic peptide"
AASSLQS

SEQ ID NO: 447 - protein, 7 aa, Artificial Sequence
  source: /note="Description of Artificial Sequence: Synthetic peptide"
AAFSLQS

SEQ ID NO: 448 - protein, 7 aa, Artificial Sequence
  source: /note="Description of Artificial Sequence: Synthetic peptide"
AASSLQS

SEQ ID NO: 449 - protein, 7 aa, Artificial Sequence
  source: /note="Description of Artificial Sequence: Synthetic peptide"
AASSLQS

SEQ ID NO: 450-472 - skipped (23 entries)

SEQ ID NO: 473 - protein, 7 aa, Artificial Sequence
  source: /note="Description of Artificial Sequence: Synthetic peptide"
SGSTLQS

SEQ ID NO: 474 - protein, 9 aa, Artificial Sequence
  source: /note="Description of Artificial Sequence: Synthetic peptide"
QQGDSVPLT

SEQ ID NO: 475 - protein, 9 aa, Artificial Sequence
  source: /note="Description of Artificial Sequence: Synthetic peptide"
QQGDSVPLT

SEQ ID NO: 476 - protein, 9 aa, Artificial Sequence
  source: /note="Description of Artificial Sequence: Synthetic peptide"
QQGDSVPLT

SEQ ID NO: 477 - protein, 9 aa, Artificial Sequence
  source: /note="Description of Artificial Sequence: Synthetic peptide"
QQGDSVPLT

SEQ ID NO: 478 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 479 - DNA, 729 bp, Artificial Sequence
  source: /note="Description of Artificial Sequence: Synthetic polynucleotide"
caagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaag

SEQ ID NO: 480 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 481 - DNA, 1760 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcttgccggttcccagaggaggaggaaggcggctgcgaactgcgcgtgaaattcagccgcagcgcagacgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaagtcgacagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcctcgacgaattc

SEQ ID NO: 482 - DNA, 729 bp, Artificial Sequence
  source: /note="Description of Artificial Sequence: Synthetic polynucleotide"
caagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaag

SEQ ID NO: 483 - protein, 243 aa, Artificial Sequence
  source: /note="Description of Artificial Sequence: Synthetic polypeptide"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 484 - DNA, 735 bp, Artificial Sequence
  source: /note="Description of Artificial Sequence: Synthetic polynucleotide"
caagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaag

SEQ ID NO: 485 - protein, 245 aa, Artificial Sequence
  source: /note="Description of Artificial Sequence: Synthetic polypeptide"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 486 - protein, 5 aa, Artificial Sequence
  source: /note="Description of Artificial Sequence: Synthetic peptide"
GYYMH

SEQ ID NO: 487 - protein, 5 aa, Artificial Sequence
  source: /note="Description of Artificial Sequence: Synthetic peptide"
GYYMH

SEQ ID NO: 488 - protein, 5 aa, Artificial Sequence
  source: /note="Description of Artificial Sequence: Synthetic peptide"
GYYIH

SEQ ID NO: 489 - protein, 5 aa, Artificial Sequence
  source: /note="Description of Artificial Sequence: Synthetic peptide"
DYYMH

SEQ ID NO: 490 - protein, 5 aa, Artificial Sequence
  source: /note="Description of Artificial Sequence: Synthetic peptide"
SYWMN

SEQ ID NO: 491 - protein, 17 aa, Artificial Sequence
  source: /note="Description of Artificial Sequence: Synthetic peptide"
WINPNSGGTNYAQKFQG

SEQ ID NO: 492 - protein, 17 aa, Artificial Sequence
  source: /note="Description of Artificial Sequence: Synthetic peptide"
WINPNSGGTNYAQKFQG

SEQ ID NO: 493 - protein, 17 aa, Artificial Sequence
  source: /note="Description of Artificial Sequence: Synthetic peptide"
WINPNSGGTNYAQKFQG

SEQ ID NO: 494 - protein, 17 aa, Artificial Sequence
  source: /note="Description of Artificial Sequence: Synthetic peptide"
WINPNSGDTNYAQKFQG

SEQ ID NO: 495 - protein, 17 aa, Artificial Sequence
  source: /note="Description of Artificial Sequence: Synthetic peptide"
RIDPYDSETHYNQKFKD

SEQ ID NO: 496 - protein, 12 aa, Artificial Sequence
  source: /note="Description of Artificial Sequence: Synthetic peptide"
DMNILATVPFDI

SEQ ID NO: 497 - protein, 12 aa, Artificial Sequence
  source: /note="Description of Artificial Sequence: Synthetic peptide"
DMNILATVPFDI

SEQ ID NO: 498 - protein, 12 aa, Artificial Sequence
  source: /note="Description of Artificial Sequence: Synthetic peptide"
DMNILATVPFDI

SEQ ID NO: 499 - protein, 12 aa, Artificial Sequence
  source: /note="Description of Artificial Sequence: Synthetic peptide"
DMNILATVPFDI

SEQ ID NO: 500 - protein, 6 aa, Artificial Sequence
  source: /note="Description of Artificial Sequence: Synthetic peptide"
GNWDDY

SEQ ID NO: 501 - protein, 11 aa, Artificial Sequence
  source: /note="Description of Artificial Sequence: Synthetic peptide"
RASQSISTYLN

SEQ ID NO: 502 - protein, 11 aa, Artificial Sequence
  source: /note="Description of Artificial Sequence: Synthetic peptide"
RASQSISTYLN

SEQ ID NO: 503 - protein, 11 aa, Artificial Sequence
  source: /note="Description of Artificial Sequence: Synthetic peptide"
RASQSISSYLN

SEQ ID NO: 504 - protein, 11 aa, Artificial Sequence
  source: /note="Description of Artificial Sequence: Synthetic peptide"
RASQSISSYLN

SEQ ID NO: 505 - protein, 11 aa, Artificial Sequence
  source: /note="Description of Artificial Sequence: Synthetic peptide"
RASKSISKDLA

SEQ ID NO: 506 - protein, 7 aa, Artificial Sequence
  source: /note="Description of Artificial Sequence: Synthetic peptide"
AAFSLQS

SEQ ID NO: 507 - protein, 7 aa, Artificial Sequence
  source: /note="Description of Artificial Sequence: Synthetic peptide"
AASSLQS

SEQ ID NO: 508 - protein, 7 aa, Artificial Sequence
  source: /note="Description of Artificial Sequence: Synthetic peptide"
AASSLQS

SEQ ID NO: 509 - protein, 7 aa, Artificial Sequence
  source: /note="Description of Artificial Sequence: Synthetic peptide"
AASSLQS

SEQ ID NO: 510 - protein, 7 aa, Artificial Sequence
  source: /note="Description of Artificial Sequence: Synthetic peptide"
SGSTLQS

SEQ ID NO: 511 - protein, 9 aa, Artificial Sequence
  source: /note="Description of Artificial Sequence: Synthetic peptide"
QQGDSVPLT

SEQ ID NO: 512 - protein, 9 aa, Artificial Sequence
  source: /note="Description of Artificial Sequence: Synthetic peptide"
QQGDSVPLT

SEQ ID NO: 513 - protein, 9 aa, Artificial Sequence
  source: /note="Description of Artificial Sequence: Synthetic peptide"
QQGDSVPLT

SEQ ID NO: 514 - protein, 9 aa, Artificial Sequence
  source: /note="Description of Artificial Sequence: Synthetic peptide"
QQGDSVPLT

SEQ ID NO: 515 - protein, 9 aa, Artificial Sequence
  source: /note="Description of Artificial Sequence: Synthetic peptide"
QQHNKYPYT

SEQ ID NO: 516 - protein, 7 aa, Artificial Sequence
  source: /note="Description of Artificial Sequence: Synthetic peptide"
GYTFTGY

SEQ ID NO: 517 - protein, 7 aa, Artificial Sequence
  source: /note="Description of Artificial Sequence: Synthetic peptide"
GYTFTGY

SEQ ID NO: 518 - protein, 7 aa, Artificial Sequence
  source: /note="Description of Artificial Sequence: Synthetic peptide"
GYIFTGY

SEQ ID NO: 519 - protein, 7 aa, Artificial Sequence
  source: /note="Description of Artificial Sequence: Synthetic peptide"
GYTFTDY

SEQ ID NO: 520 - protein, 7 aa, Artificial Sequence
  source: /note="Description of Artificial Sequence: Synthetic peptide"
GYTFTSY

SEQ ID NO: 521 - protein, 6 aa, Artificial Sequence
  source: /note="Description of Artificial Sequence: Synthetic peptide"
NPNSGG

SEQ ID NO: 522 - protein, 6 aa, Artificial Sequence
  source: /note="Description of Artificial Sequence: Synthetic peptide"
NPNSGG

SEQ ID NO: 523 - protein, 6 aa, Artificial Sequence
  source: /note="Description of Artificial Sequence: Synthetic peptide"
NPNSGG

SEQ ID NO: 524 - protein, 6 aa, Artificial Sequence
  source: /note="Description of Artificial Sequence: Synthetic peptide"
NPNSGD

SEQ ID NO: 525 - protein, 6 aa, Artificial Sequence
  source: /note="Description of Artificial Sequence: Synthetic peptide"
DPYDSE

SEQ ID NO: 526 - protein, 12 aa, Artificial Sequence
  source: /note="Description of Artificial Sequence: Synthetic peptide"
DMNILATVPFDI

SEQ ID NO: 527 - protein, 12 aa, Artificial Sequence
  source: /note="Description of Artificial Sequence: Synthetic peptide"
DMNILATVPFDI

SEQ ID NO: 528 - protein, 12 aa, Artificial Sequence
  source: /note="Description of Artificial Sequence: Synthetic peptide"
DMNILATVPFDI

SEQ ID NO: 529 - protein, 12 aa, Artificial Sequence
  source: /note="Description of Artificial Sequence: Synthetic peptide"
DMNILATVPFDI

SEQ ID NO: 530 - protein, 6 aa, Artificial Sequence
  source: /note="Description of Artificial Sequence: Synthetic peptide"
GNWDDY

SEQ ID NO: 531 - protein, 7 aa, Artificial Sequence
  source: /note="Description of Artificial Sequence: Synthetic peptide"
SQSISTY

SEQ ID NO: 532 - protein, 7 aa, Artificial Sequence
  source: /note="Description of Artificial Sequence: Synthetic peptide"
SQSISSY

SEQ ID NO: 533 - protein, 7 aa, Artificial Sequence
  source: /note="Description of Artificial Sequence: Synthetic peptide"
SQSISSY

SEQ ID NO: 534 - protein, 7 aa, Artificial Sequence
  source: /note="Description of Artificial Sequence: Synthetic peptide"
SQSISSY

SEQ ID NO: 535 - protein, 7 aa, Artificial Sequence
  source: /note="Description of Artificial Sequence: Synthetic peptide"
SKSISKD

SEQ ID NO: 536 - protein, 3 aa, Artificial Sequence
  source: /note="Description of Artificial Sequence: Synthetic peptide"
AAF

SEQ ID NO: 537 - protein, 3 aa, Artificial Sequence
  source: /note="Description of Artificial Sequence: Synthetic peptide"
AAS

SEQ ID NO: 538 - protein, 3 aa, Artificial Sequence
  source: /note="Description of Artificial Sequence: Synthetic peptide"
AAS

SEQ ID NO: 539 - protein, 3 aa, Artificial Sequence
  source: /note="Description of Artificial Sequence: Synthetic peptide"
AAS

SEQ ID NO: 540 - protein, 3 aa, Artificial Sequence
  source: /note="Description of Artificial Sequence: Synthetic peptide"
SGS

SEQ ID NO: 541 - protein, 6 aa, Artificial Sequence
  source: /note="Description of Artificial Sequence: Synthetic peptide"
GDSVPL

SEQ ID NO: 542 - protein, 6 aa, Artificial Sequence
  source: /note="Description of Artificial Sequence: Synthetic peptide"
GDSVPL

SEQ ID NO: 543 - protein, 6 aa, Artificial Sequence
  source: /note="Description of Artificial Sequence: Synthetic peptide"
GDSVPL

SEQ ID NO: 544 - protein, 6 aa, Artificial Sequence
  source: /note="Description of Artificial Sequence: Synthetic peptide"
GDSVPL

SEQ ID NO: 545-554 - skipped (10 entries)

SEQ ID NO: 555 - protein, 6 aa, Artificial Sequence
  source: /note="Description of Artificial Sequence: Synthetic peptide"
HNKYPY

SEQ ID NO: 556 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 557 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 558 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 559 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 560 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 561 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 562 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 563 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 564 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 565 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 566 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 567 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 568 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 569 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 570 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 571 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 572 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 573 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 574 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 575 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 576 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 577 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 578 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 579 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 580 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 581 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 582 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 583 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 584 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 585 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 586 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 587 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 588 - protein, 132 aa, Artificial Sequence
  source: /note="Description of Artificial Sequence: Synthetic polypeptide"
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 589 - protein, 108 aa, Artificial Sequence
  source: /note="Description of Artificial Sequence: Synthetic polypeptide"
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 590 - protein, 93 aa, Artificial Sequence [sequence omitted]

SEQ ID NO: 591 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 592 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 593 - protein, 95 aa, Artificial Sequence
  source: /note="Description of Artificial Sequence: Synthetic polypeptide"
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 594 - protein, 95 aa, Artificial Sequence
  source: /note="Description of Artificial Sequence: Synthetic polypeptide"
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 595 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 596 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 597 - DNA, 521 bp, Homo sapiens
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 598 - DNA, 118 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 599 - DNA, 221 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 600 - DNA, 324 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 601 - DNA, 422 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 602 - protein, 21 aa, Artificial Sequence
  source: /note="Description of Artificial Sequence: Synthetic peptide"
  VARIANT (1)..(3): /replace=" "
  MISC_FEATURE (1)..(21): /note="Variant residues given in the sequence have no preference with respect to those in the annotations for variant positions"
GSGEGRGSLLTCGDVEENPGP

SEQ ID NO: 603 - protein, 22 aa, Artificial Sequence
  source: /note="Description of Artificial Sequence: Synthetic peptide"
  VARIANT (1)..(3): /replace=" "
  MISC_FEATURE (1)..(22): /note="Variant residues given in the sequence have no preference with respect to those in the annotations for variant positions"
GSGATNFSLLKQAGDVEENPGP

SEQ ID NO: 604 - protein, 23 aa, Artificial Sequence
  source: /note="Description of Artificial Sequence: Synthetic peptide"
  VARIANT (1)..(3): /replace=" "
  MISC_FEATURE (1)..(23): /note="Variant residues given in the sequence have no preference with respect to those in the annotations for variant positions"
GSGQCTNYALLKLAGDVESNPGP

SEQ ID NO: 605 - protein, 25 aa, Artificial Sequence
  source: /note="Description of Artificial Sequence: Synthetic peptide"
  VARIANT (1)..(3): /replace=" "
  MISC_FEATURE (1)..(25): /note="Variant residues given in the sequence have no preference with respect to those in the annotations for variant positions"
GSGVKQTLNFDLLKLAGDVESNPGP

SEQ ID NO: 606 - protein, 1132 aa, Homo sapiens [sequence omitted]

SEQ ID NO: 607 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 608 - DNA, 19 bp, Mus musculus
ggaggtccctcaccttcta

SEQ ID NO: 609 - DNA, 19 bp, Mus musculus
cggaggatcttatgctgaa

SEQ ID NO: 610 - DNA, 19 bp, Mus musculus
cccgcttccagatcataca

SEQ ID NO: 611 - DNA, 19 bp, Mus musculus
ggagacctcaacaagatat

SEQ ID NO: 612 - DNA, 19 bp, Mus musculus
aaggcatggtcattggtat

SEQ ID NO: 613 - DNA, 19 bp, Mus musculus
gcatggtcattggtatcat

SEQ ID NO: 614 - DNA, 19 bp, Mus musculus
ggtcattggtatcatgagt

SEQ ID NO: 615 - DNA, 19 bp, Mus musculus
cctagtgggtatccctgta

SEQ ID NO: 616 - DNA, 19 bp, Mus musculus
gaggatggacattgttctt

SEQ ID NO: 617 - DNA, 19 bp, Mus musculus
gcatgcaggctacagttca

SEQ ID NO: 618 - DNA, 19 bp, Mus musculus
ccagcacatgcactgttga

SEQ ID NO: 619 - DNA, 19 bp, Mus musculus
cacatgcactgttgagtga

SEQ ID NO: 620 - DNA, 21 bp, Mus musculus
ctggaggtccctcaccttcta

SEQ ID NO: 621 - DNA, 21 bp, Mus musculus
gtcggaggatcttatgctgaa

SEQ ID NO: 622 - DNA, 21 bp, Mus musculus
tgcccgcttccagatcataca

SEQ ID NO: 623 - DNA, 21 bp, Mus musculus
ctggagacctcaacaagatat

SEQ ID NO: 624 - DNA, 21 bp, Mus musculus
tcaaggcatggtcattggtat

SEQ ID NO: 625 - DNA, 21 bp, Mus musculus
aggcatggtcattggtatcat

SEQ ID NO: 626 - DNA, 21 bp, Mus musculus
atggtcattggtatcatgagt

SEQ ID NO: 627 - DNA, 21 bp, Mus musculus
gccctagtgggtatccctgta

SEQ ID NO: 628 - DNA, 21 bp, Mus musculus
atgaggatggacattgttctt

SEQ ID NO: 629 - DNA, 21 bp, Mus musculus
gagcatgcaggctacagttca

SEQ ID NO: 630 - DNA, 21 bp, Mus musculus
ttccagcacatgcactgttga

SEQ ID NO: 631 - DNA, 21 bp, Mus musculus
agcacatgcactgttgagtga

SEQ ID NO: 632 - DNA, 21 bp, Mus musculus
tagaaggtgagggacctccag

SEQ ID NO: 633 - DNA, 21 bp, Mus musculus
ttcagcataagatcctccgac

SEQ ID NO: 634 - DNA, 21 bp, Mus musculus
tgtatgatctggaagcgggca

SEQ ID NO: 635 - DNA, 21 bp, Mus musculus
atatcttgttgaggtctccag

SEQ ID NO: 636 - DNA, 21 bp, Mus musculus
ataccaatgaccatgccttga

SEQ ID NO: 637 - DNA, 21 bp, Mus musculus
atgataccaatgaccatgcct

SEQ ID NO: 638 - DNA, 21 bp, Mus musculus
atggtcattggtatcatgagt

SEQ ID NO: 639 - DNA, 21 bp, Mus musculus
gccctagtgggtatccctgta

SEQ ID NO: 640 - DNA, 21 bp, Mus musculus
atgaggatggacattgttctt

SEQ ID NO: 641 - DNA, 21 bp, Mus musculus
gagcatgcaggctacagttca

SEQ ID NO: 642 - DNA, 21 bp, Mus musculus
ttccagcacatgcactgttga

SEQ ID NO: 643 - DNA, 21 bp, Mus musculus
agcacatgcactgttgagtga

SEQ ID NO: 644 - DNA, 19 bp, Mus musculus
tagaaggtgagggacctcc

SEQ ID NO: 645 - DNA, 19 bp, Mus musculus
ttcagcataagatcctccg

SEQ ID NO: 646 - DNA, 19 bp, Mus musculus
tgtatgatctggaagcggg

SEQ ID NO: 647 - DNA, 19 bp, Mus musculus
atatcttgttgaggtctcc

SEQ ID NO: 648 - DNA, 19 bp, Mus musculus
ataccaatgaccatgcctt

SEQ ID NO: 649 - DNA, 19 bp, Mus musculus
atgataccaatgaccatgc

SEQ ID NO: 650 - DNA, 19 bp, Mus musculus
atggtcattggtatcatga

SEQ ID NO: 651 - DNA, 19 bp, Mus musculus
gccctagtgggtatccctg

SEQ ID NO: 652 - DNA, 19 bp, Mus musculus
atgaggatggacattgttc

SEQ ID NO: 653 - DNA, 19 bp, Mus musculus
gagcatgcaggctacagtt

SEQ ID NO: 654 - DNA, 19 bp, Mus musculus
ttccagcacatgcactgtt

SEQ ID NO: 655 - DNA, 19 bp, Mus musculus
agcacatgcactgttgagt

SEQ ID NO: 656 - DNA, 19 bp, Homo sapiens
ggccaggatggttcttaga

SEQ ID NO: 657 - DNA, 19 bp, Homo sapiens
gcttcgtgctaaactggta

SEQ ID NO: 658 - DNA, 19 bp, Homo sapiens
gggcgtgacttccacatga

SEQ ID NO: 659 - DNA, 19 bp, Homo sapiens
caggcctagagaagtttca

SEQ ID NO: 660 - DNA, 19 bp, Homo sapiens
cttggaacccattcctgaa

SEQ ID NO: 661 - DNA, 19 bp, Homo sapiens
ggaacccattcctgaaatt

SEQ ID NO: 662 - DNA, 19 bp, Homo sapiens
gaacccattcctgaaatta

SEQ ID NO: 663 - DNA, 19 bp, Homo sapiens
aacccattcctgaaattat

SEQ ID NO: 664 - DNA, 19 bp, Homo sapiens
acccattcctgaaattatt

SEQ ID NO: 665 - DNA, 19 bp, Homo sapiens
cccattcctgaaattattt

SEQ ID NO: 666 - DNA, 19 bp, Homo sapiens
ctgtggttctattatatta

SEQ ID NO: 667 - DNA, 19 bp, Homo sapiens
aaatatgagagcatgctaa

SEQ ID NO: 668 - DNA, 19 bp, Homo sapiens
tctaagaaccatcctggcc

SEQ ID NO: 669 - DNA, 19 bp, Homo sapiens
taccagtttagcacgaagc

SEQ ID NO: 670 - DNA, 19 bp, Homo sapiens
tcatgtggaagtcacgccc

SEQ ID NO: 671 - DNA, 19 bp, Homo sapiens
tgaaacttctctaggcctg

SEQ ID NO: 672 - DNA, 19 bp, Homo sapiens
ttcaggaatgggttccaag

SEQ ID NO: 673 - DNA, 19 bp, Homo sapiens
aatttcaggaatgggttcc

SEQ ID NO: 674 - DNA, 19 bp, Homo sapiens
taatttcaggaatgggttc

SEQ ID NO: 675 - DNA, 19 bp, Homo sapiens
ataatttcaggaatgggtt

SEQ ID NO: 676 - DNA, 19 bp, Homo sapiens
aataatttcaggaatgggt

SEQ ID NO: 677 - DNA, 19 bp, Homo sapiens
aaataatttcaggaatggg

SEQ ID NO: 678 - DNA, 19 bp, Homo sapiens
taatataatagaaccacag

SEQ ID NO: 679 - DNA, 19 bp, Homo sapiens
ttagcatgctctcatattt

SEQ ID NO: 680 - DNA, 21 bp, Homo sapiens
gcggccaggatggttcttaga

SEQ ID NO: 681 - DNA, 21 bp, Homo sapiens
gagcttcgtgctaaactggta

SEQ ID NO: 682 - DNA, 21 bp, Homo sapiens
acgggcgtgacttccacatga

SEQ ID NO: 683 - DNA, 21 bp, Homo sapiens
tgcaggcctagagaagtttca

SEQ ID NO: 684 - DNA, 21 bp, Homo sapiens
tccttggaacccattcctgaa

SEQ ID NO: 685 - DNA, 21 bp, Homo sapiens
ttggaacccattcctgaaatt

SEQ ID NO: 686 - DNA, 21 bp, Homo sapiens
tggaacccattcctgaaatta

SEQ ID NO: 687 - DNA, 21 bp, Homo sapiens
ggaacccattcctgaaattat

SEQ ID NO: 688 - DNA, 21 bp, Homo sapiens
gaacccattcctgaaattatt

SEQ ID NO: 689 - DNA, 21 bp, Homo sapiens
aacccattcctgaaattattt

SEQ ID NO: 690 - DNA, 21 bp, Homo sapiens
ccctgtggttctattatatta

SEQ ID NO: 691 - DNA, 21 bp, Homo sapiens
ttaaatatgagagcatgctaa

SEQ ID NO: 692 - DNA, 21 bp, Homo sapiens
tctaagaaccatcctggccgc

SEQ ID NO: 693 - DNA, 21 bp, Homo sapiens
taccagtttagcacgaagctc

SEQ ID NO: 694 - DNA, 21 bp, Homo sapiens
tcatgtggaagtcacgcccgt

SEQ ID NO: 695 - DNA, 21 bp, Homo sapiens
tgaaacttctctaggcctgca

SEQ ID NO: 696 - DNA, 21 bp, Homo sapiens
ttcaggaatgggttccaagga

SEQ ID NO: 697 - DNA, 21 bp, Homo sapiens
aatttcaggaatgggttccaa

SEQ ID NO: 698 - DNA, 21 bp, Homo sapiens
taatttcaggaatgggttcca

SEQ ID NO: 699 - DNA, 21 bp, Homo sapiens
ataatttcaggaatgggttcc

SEQ ID NO: 700 - DNA, 21 bp, Homo sapiens
aataatttcaggaatgggttc

SEQ ID NO: 701 - DNA, 21 bp, Homo sapiens
aaataatttcaggaatgggtt

SEQ ID NO: 702 - DNA, 21 bp, Homo sapiens
taatataatagaaccacaggg

SEQ ID NO: 703 - DNA, 21 bp, Homo sapiens
ttagcatgctctcatatttaa

SEQ ID NO: 704 - protein, 18 aa, Artificial Sequence
  source: /note="Description of Artificial Sequence: Synthetic peptide"
GSTSGSGKPGSGEGSTKG

SEQ ID NO: 705 - DNA, 150 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 706 - protein, 4 aa, Artificial Sequence
  source: /note="Description of Artificial Sequence: Synthetic peptide"
RGDS

SEQ ID NO: 707 - protein, 494 aa, Artificial Sequence
  source: /note="Description of Artificial Sequence: Synthetic polypeptide"
MALPVTALLLPLALLLHAARPGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSASSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 708 - protein, 487 aa, Artificial Sequence
  source: /note="Description of Artificial Sequence: Synthetic polypeptide"
MALPVTALLLPLALLLHAARPGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSSGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSASSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 709 - protein, 40 aa, Artificial Sequence
  source: /note="Description of Artificial Sequence: Synthetic polypeptide"
  MISC_FEATURE (1)..(40): /note="This sequence may encompass 1-10 "Gly Gly Gly Ser" repeating units"
GGGSGGGSGGGSGGGSGGGSGGGSGGGSGGGSGGGSGGGS

What is claimed is:

1. An isolated nucleic acid molecule encoding a chimeric antigen receptor (CAR), wherein the CAR comprises a CD123 binding domain, a transmembrane domain, and an intracellular signaling domain, and wherein said CD123 binding domain comprises:
   (a) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 487, HC CDR2 comprises the amino acid sequence of SEQ ID NO: 492, and HC CDR3 comprises the amino acid sequence of SEQ ID NO: 497; and
   a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 502, LC CDR2 comprises the amino acid sequence of SEQ ID NO: 507, and LC CDR3 comprises the amino acid sequence of SEQ ID NO: 512; or
   (b) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 517, HC CDR2 comprises the amino acid sequence of SEQ ID NO: 522, and HC CDR3 comprises the amino acid sequence of SEQ ID NO: 527; and
   a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 532, LC CDR2 comprises the amino acid sequence of SEQ ID NO: 537, and LC CDR3 comprises the amino acid sequence of SEQ ID NO: 542; or
   (c) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 335, HC CDR2 comprises the amino acid sequence of SEQ ID NO: 363, and HC CDR3 comprises the amino acid sequence of SEQ ID NO: 391; and
   a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 419, LC CDR2 comprises the amino acid sequence of SEQ ID NO: 447, and LC CDR3 comprises the amino acid sequence of SEQ ID NO: 475.

2. The isolated nucleic acid molecule of claim 1, which encodes a CAR comprising:
   (i) the amino acid sequence of the light chain variable region of SEQ ID NO: 276; or
   (ii) an amino acid sequence with 95-99% identity to the amino acid sequence of the light chain variable region of SEQ ID NO: 276.

3. The isolated nucleic acid molecule of claim 1, which encodes a CAR comprising:
   (i) the amino acid sequence of the heavy chain variable region of SEQ ID NO: 217; or
   (ii) an amino acid sequence with 95-99% identity to the amino acid sequence of the heavy chain variable region of SEQ ID NO: 217.

4. The isolated nucleic acid molecule of claim 1, which encodes a CAR comprising the amino acid sequence of the light chain variable region of SEQ ID NO: 276, and the amino acid sequence of the heavy chain variable region of SEQ ID NO: 217.

5. The isolated nucleic acid molecule of claim 1, wherein the encoded CD123 binding domain comprises:
   (i) the amino acid sequence of SEQ ID NO:480;
   (ii) an amino acid sequence having at least one, two or three modifications but not more than 10 modifications to SEQ ID NO: 480; or
   (iii) an amino acid sequence with 95-99% identity to SEQ ID NO: 480.

6. The isolated nucleic acid molecule of claim 1, wherein the CD123 binding domain comprises a nucleotide sequence chosen from SEQ ID NO: 479 and 481, or a nucleotide sequence with 95-99% identity thereof.

7. The isolated nucleic acid molecule of claim 1, wherein:
   (i) the encoded CAR comprises a transmembrane domain that comprises a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154; or
   (ii) the encoded transmembrane domain comprises the amino acid sequence of SEQ ID NO: 6, or an amino acid sequence with 95-99% identity to the amino acid sequence of SEQ ID NO:6; or
   (iii) the nucleic acid sequence encoding the transmembrane domain comprises nucleotides 928-999 of sequence of SEQ ID NO: 40, or a nucleotide sequence with 95-99% identity thereof.

8. The isolated nucleic acid molecule of claim 1, wherein the encoded CD123 binding domain is connected to the transmembrane domain by a hinge region, wherein
   (i) the encoded hinge region comprises the amino acid sequence of SEQ ID NO:2, or an amino acid sequence with 95-99% identity to SEQ ID NO: 2; or
   (ii) the nucleic acid sequence encoding the hinge region comprises nucleotides 793-927 of sequence of SEQ ID NO: 40, or a nucleotide sequence with 95-99% identity thereof.

9. The isolated nucleic acid molecule of claim 1, wherein the encoded intracellular domain comprises a costimulatory domain, wherein the costimulatory domain comprises a functional signaling domain derived from a protein selected from the group consisting of a MHC class I molecule, a TNF receptor protein, an Immunoglobulin-like protein, a cytokine receptor, an integrin, a signaling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1(CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, and PAG/Cbp.

10. The isolated nucleic acid molecule of claim 9, wherein the costimulatory domain comprises the amino acid sequence of SEQ ID NO:7; or an amino acid sequence with 95-99% identity to the amino acid sequence of SEQ ID NO:7.

11. The isolated nucleic acid molecule of claim 9, wherein the nucleic acid sequence encoding the costimulatory domain comprises nucleotides 1000-1125 of sequence of SEQ ID NO: 40, or a nucleotide sequence with 95-99% identity thereof.

12. The isolated nucleic acid molecule of claim 1, wherein the encoded intracellular signaling domain comprises a functional signaling domain of 4-1BB and a functional signaling domain of CD3 zeta.

13. The isolated nucleic acid molecule of claim 1, wherein the encoded intracellular signaling domain comprises the amino acid sequence of SEQ ID NO: 7 and the amino acid sequence of SEQ ID NO:9 or SEQ ID NO:10; or an amino acid sequence with 95-99% identity to the amino acid sequence of SEQ ID NO:7 and the amino acid sequence of SEQ ID NO:9 or SEQ ID NO:10.

14. The isolated nucleic acid molecule of claim 1, wherein the encoded intracellular signaling domain comprises the amino acid sequence of SEQ ID NO:7 and the amino acid sequence of SEQ ID NO:9 or SEQ ID NO:10, wherein the sequences comprising the intracellular signaling domain are expressed in the same frame and as a single polypeptide chain.

15. The isolated nucleic acid molecule of claim 1, wherein the nucleic acid sequence encoding the intracellular signaling domain comprises nucleotides 1000-1125 of sequence of SEQ ID NO: 40, or a nucleotide sequence with 95-99% identity thereof, and/or nucleotides 1126-1461 of SEQ ID NO: 40 or SEQ ID NO:21, or a nucleotide sequence with 95-99% identity thereof.

16. The isolated nucleic acid molecule of claim 1, further comprising a leader sequence which encodes the amino acid sequence of SEQ ID NO:1.

17. The isolated nucleic acid molecule of claim 1, which encodes a CAR comprising:
  (i) the amino acid sequence of SEQ ID NO: 99;
  (ii) an amino acid sequence having at least one, two or three modifications but not more than 10 modifications to SEQ ID NO: 99; or
  (iii) an amino acid sequence with 95-99% identity to SEQ ID NO: 99.

18. The isolated nucleic acid molecule of claim 1, comprising the nucleotide sequence of SEQ ID NO: 40, or a nucleotide sequence with 95-99% identity to SEQ ID NO: 40.

19. An isolated chimeric antigen receptor (CAR) polypeptide, wherein the CAR comprises a CD123 binding domain, a transmembrane domain, and an intracellular signaling domain, and wherein said CD123 binding domain comprises:
  (a) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 487, HC CDR2 comprises the amino acid sequence of SEQ ID NO: 492, and HC CDR3 comprises the amino acid sequence of SEQ ID NO: 497; and
  a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 502, LC CDR2 comprises the amino acid sequence of SEQ ID NO: 507, and LC CDR3 comprises the amino acid sequence of SEQ ID NO: 512; or
  (b) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 517, HC CDR2 comprises the amino acid sequence of SEQ ID NO: 522, and HC CDR3 comprises the amino acid sequence of SEQ ID NO: 527; and
  a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 532, LC CDR2comprises the amino acid sequence of SEQ ID NO: 537, and LC CDR3 comprises the amino acid sequence of SEQ ID NO: 542; or
  (c) a heavy chain variable domain comprising three complementary determining regions of heavy chain complementary determining region 1 (HC CDR1), heavy chain complementary determining region 2 (HC CDR2), and heavy chain complementary determining region 3 (HC CDR3) present in order of HC CDR1, HC CDR2, and HC CDR3, wherein HC CDR1 comprises the amino acid sequence of SEQ ID NO: 335, HC CDR2 comprises the amino acid sequence of SEQ ID NO: 363, and HC CDR3 comprises the amino acid sequence of SEQ ID NO: 391; and
  a light chain variable domain comprising three complementary determining regions of light chain complementary determining region 1 (LC CDR1), light chain complementary determining region 2 (LC CDR2), and light chain complementary determining region 3 (LC CDR3) present in order of LC CDR1, LC CDR2, and LC CDR3, wherein LC CDR1 comprises the amino acid sequence of SEQ ID NO: 419, LC CDR2 comprises the amino acid sequence of SEQ ID NO: 447, and LC CDR3 comprises the amino acid sequence of SEQ ID NO: 475.

20. The isolated CAR polypeptide of claim 19, comprising:
 (i) the amino acid sequence of the light chain variable region of SEQ ID NO: 276; or
 (ii) an amino acid sequence with 95-99% identity to the amino acid sequence of the light chain variable region of SEQ ID NO: 276.

21. The isolated CAR polypeptide of claim 19, comprising:
 (i) the amino acid sequence of the heavy chain variable region of SEQ ID NO: 217; or
 (ii) an amino acid sequence with 95-99% identity to the amino acid sequence of the heavy chain variable region of SEQ ID NO: 217.

22. The isolated CAR polypeptide of claim 19, comprising the amino acid sequence of the light chain variable region of SEQ ID NO: 276, and the amino acid sequence of the heavy chain variable region of SEQ ID NO: 217.

23. The isolated CAR polypeptide of claim 19, comprising:
 (i) the amino acid sequence of SEQ ID NO:480;
 (ii) an amino acid sequence having at least one, two or three modifications but not more than 10 modifications to SEQ ID NO: 480; or (iii) an amino acid sequence with 95-99% identity to SEQ ID NO: 480.

24. The isolated CAR polypeptide of claim 19, wherein the transmembrane domain comprises a transmembrane domain from a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154.

25. The isolated CAR polypeptide of claim 19, wherein the transmembrane domain comprises:
 (i) the amino acid sequence of SEQ ID NO: 6, or
 (ii) a sequence with 95-99% identity to the amino acid sequence of SEQ ID NO:6.

26. The isolated CAR polypeptide of claim 19, wherein the CD123 binding domain is connected to the transmembrane domain by a hinge region, wherein the hinge region comprises SEQ ID NO:2, or a sequence with 95-99% identity thereof.

27. The isolated CAR polypeptide of claim 19, wherein the encoded intracellular domain comprises a costimulatory domain, wherein the costimulatory domain comprises a functional signaling domain derived from a protein selected from the group consisting of a MHC class I molecule, a TNF receptor protein, an Immunoglobulin-like protein, a cytokine receptor, an integrin, a signaling lymphocytic activation molecule (SLAM protein), an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, and PAG/Cbp.

28. The isolated CAR polypeptide of claim 19, wherein the costimulatory domain comprises the amino acid sequence of SEQ ID NO:7, or a sequence with 95-99% identity to the amino acid sequence of SEQ ID NO:7.

29. The isolated CAR polypeptide of claim 19, wherein the intracellular signaling domain comprises a functional signaling domain of 4-1BB and a functional signaling domain of CD3 zeta.

30. The isolated CAR polypeptide of claim 19, wherein the intracellular signaling domain comprises the amino acid sequence of SEQ ID NO: 7 and the amino acid sequence of SEQ ID NO:9 or SEQ ID NO:10; or an amino acid sequence with 95-99% identity to the amino acid sequence of SEQ ID NO:7 and the amino acid sequence of SEQ ID NO:9 or SEQ ID NO:10.

31. The isolated CAR polypeptide of claim 19, comprising:
 (i) the amino acid sequence of SEQ ID NO: 99;
 (ii) an amino acid sequence having at least one, two or three modifications but not more than 10 modifications to SEQ ID NO: 99; or
 (iii) an amino acid sequence with 95-99% identity to SEQ ID NO: 99.

32. A vector comprising the nucleic acid molecule of claim 1, wherein the vector is a DNA vector, an RNA vector, a plasmid, a lentivirus vector, adenoviral vector, or a retrovirus vector.

33. An isolated immune effector cell comprising the nucleic acid molecule of claim 1.

34. A method of making an immune effector cell, comprising transducing the immune effector cell with the vector of claim 32.

35. A method of generating a population of RNA-engineered cells, comprising introducing an in vitro transcribed RNA or synthetic RNA into a cell, wherein the RNA comprises the nucleic acid molecule of claim 1.

36. The isolated cell of claim 33, further expressing a chimeric molecule that comprises a first polypeptide that comprises at least a portion of an inhibitory molecule, associated with a second polypeptide that comprises a positive signal from an intracellular signaling domain.

37. The isolated nucleic acid molecule of claim 1, wherein the encoded intracellular signaling domain comprises a primary signaling domain comprising a functional signaling domain derived from CD3 zeta, TCR zeta, FcR gamma, FcR beta, CD3 gamma, CD3 delta , CD3 epsilon, CD5, CD22, CD79a, CD79b, CD278, FcεRI, DAP10, DAP12, or CD66d.

38. The isolated nucleic acid molecule of claim 37, wherein the primary signaling domain comprises a functional signaling domain of CD3 zeta, wherein the CD3 zeta comprises the amino acid sequence of SEQ ID NO: 9 or SEQ ID NO: 10, or a sequence with 95-99% identity to the amino acid sequence of SEQ ID NO: 9 or SEQ ID NO: 10.

39. The isolated CAR polypeptide of claim 19, wherein the intracellular signaling domain comprises a primary signaling domain comprising a functional signaling domain derived from CD3 zeta, TCR zeta, FcR gamma, FcR beta, CD3 gamma, CD3 delta , CD3 epsilon, CD5, CD22, CD79a, CD79b, CD278, FcεRI, DAP10, DAP12, or CD66d.

40. The isolated CAR polypeptide of claim 39, wherein the primary signaling domain comprises a functional signaling domain of CD3 zeta, wherein the CD3 zeta comprises the amino acid sequence of SEQ ID NO: 9 or SEQ ID NO: 10, or a sequence with 95-99% identity to the amino acid sequence of SEQ ID NO: 9 or SEQ ID NO: 10.

* * * * *